US008093032B2

(12) United States Patent
Kumar et al.

(10) Patent No.: US 8,093,032 B2
(45) Date of Patent: Jan. 10, 2012

(54) MUTANTS OF STREPTOKINASE AND THEIR COVALENTLY MODIFIED FORMS

(75) Inventors: Shekhar Kumar, Chandigarh (IN); Neeraj Maheshwari, Chandigarh (IN); Girish Sahni, Chandigarh (IN)

(73) Assignee: Council of Scientific and Industrial Research, New Delhi (IN)

( * ) Notice: Subject to any disclaimer, the term of this patent is extended or adjusted under 35 U.S.C. 154(b) by 0 days.

(21) Appl. No.: 12/415,142

(22) Filed: Mar. 31, 2009

(65) Prior Publication Data

US 2010/0034804 A1 Feb. 11, 2010

(30) Foreign Application Priority Data

Mar. 31, 2008 (IN) .......................... 0837/DEL/2008

(51) Int. Cl.

| | |
|---|---|
| *C12N 9/00* | (2006.01) |
| *C12N 9/70* | (2006.01) |
| *C12N 1/20* | (2006.01) |
| *C12N 15/00* | (2006.01) |
| *C07H 21/04* | (2006.01) |

(52) U.S. Cl. ..................... 435/216; 435/183; 435/252.3; 435/320.1; 536/23.2

(58) Field of Classification Search ........................ None
See application file for complete search history.

(56) References Cited

U.S. PATENT DOCUMENTS 5,766,897 A 6/1998 Braxton
6,087,332 A 7/2000 Galler

FOREIGN PATENT DOCUMENTS

WO 00/21574 A2 4/2000

OTHER PUBLICATIONS

Chica et al. Curr Opin Biotechnol. Aug. 2005;16(4):378-84.*
Sen et al. Appl Biochem Biotechnol. Dec. 2007;143(3):212-23.*
Nucci et al. , The Therapeutic Value of Poly(Ethylene Glycol)—Modified Proteins—Advanced Drug Delivery reviews—Mar. 1, 1991—pp. 133-151—vol. 6—No. 2—USA.
International Search Report dated Nov. 4, 2010 for International Application No. PCT/IN2009/000212.

* cited by examiner

*Primary Examiner* — Christian Fronda
(74) *Attorney, Agent, or Firm* — Morgan, Lewis & Bockius LLP

(57) ABSTRACT

The present invention relates to novel mutants of Streptokinase, its functional fragments and covalently modified forms. Methods are provided for the preparation of the bacterial plasminogen activator protein, Streptokinase its muteins, species variants and their covalently modified variants that are characterized by improved therapeutic properties, such as increased proteolytic stability, extended plasma half-lives, reduced immuno-reactivity and enhanced fibrin clot specificity. The method involves either incorporating additional cysteine residues, or substituting cysteine residues for naturally occurring amino acids into non-essential regions of the protein such that the catalytic activity of the resultant protein remains largely unaltered. These cysteine variants were further modified by covalently attaching a cysteine reactive polymer such as polyethylene glycol (PEG) or sulfhydryl-reactive moieties from a group that includes fluorophore, spin labels or other small conjugates. Disclosed herein are site-specific biologically active conjugates of Streptokinases and its covalently modified variants.

12 Claims, 3 Drawing Sheets

Fig.1 SDS PAGE showing purified cysteine variants of SK and their PEG adducts.

MUTANTS OF STREPTOKINASE AND THEIR COVALENTLY MODIFIED FORMS

CROSS-REFERENCE TO RELATED APPLICATIONS

The application claims priority to Indian Application No. 0837/DEL/2008, filed 31 Mar. 2008, which is incorporated by reference in its entirety.

REFERENCE TO SEQUENCE LISTING

A text file of a computer readable version of the sequence listing, entitled SEQ_List__102082__5001.txt" and having a size of about 1,952 kb has been submitted on 11 Apr. 2011 herewith and is incorporated by reference.

BACKGROUND OF THE INVENTION

1. Field of the Invention

The present invention relates to mutants of streptokinase and their covalently modified forms. The present invention utilizes the homogenous, site-specific and defined PEG modification of streptokinase and its related variants with substitutions, additions, deletions or domain fusion constructs to allow their usage in the form of improved protein therapeutics.

2. Background of the Invention

Thrombus (blood clot) development in the circulatory system can cause vascular blockage leading to fatal conditions. Development of clot and its dissolution is a highly controlled process for the hemostasis. Any deviation from a normal hemostasis leads to various clinical conditions such as stroke, pulmonary embolism, deep vain thrombosis and acute myocardial infraction. Patho-physiological conditions emerging out of failed hemostasis needs immediate clinical attention. The most practiced medical intervention for such cases is intravenous administration of thrombolytic agents (Collen et al., 1988; Collen, 1990; Francis and Marder, 1991). The most commonly used thrombolytic agents include Streptokinase (SK), Urokinase (UK) and the tissue type plasminogen activator (tPA). Numerous pharmacoeconomic appraisal of use of different thrombolytics in the management of acute myocardial infarction have been carried out in the past (Mucklow, 1995; Gillis and Goa, 1996). Banerjee et. al., 2004, have reviewed the clinical usefulness of streptokinase and its applicability as a drug of choice. As far as clinical efficacy is concerned both streptokinase and tPA fair equally good but due to several fold low cost and a slightly better in vivo half life, streptokinase is most preferred thrombolytic worldwide (Sherry and Marder, 1991, Wu et al., 1998). Also, the use of tPA is slightly more likely to cause strokes, the major side effect for both the drugs. However streptokinase, being a bacterial protein is antigenic in nature and may give rise to clinical complications such as allergic response or hemorrhage. Also, the circulating half-life (15-30 min) of streptokinase is not sufficient for effective thrombolysis (Wu et al., 1998).

Despite all these, in recent years, thrombolytic therapy with fibrinolytic agents, such as Streptokinase (SK), tissue plasminogen activator (TPA) or urokinase (UK) has revolutionized the clinical management of diverse circulatory diseases e.g., deep-vein thrombosis, pulmonary embolism and myocardial infarction. These agents exert their fibrinolytic effects through activation of plasminogen (PG) in the circulation by cleavage of the scissile peptide bond between residues 561 and 562 in PG. As a result, inactive zymogen is transformed to its active form, the serine protease, plasmin (PN), which then circulates in the system and acts on fibrin to degrade the later into soluble degradation products. It may be mentioned here that PN, by itself, is incapable of activating PG to PN; this reaction is catalyzed by highly specific proteases like TPA, the SK-plasminogen complex, and UK, all of which possess an unusually narrow protein substrate preference, namely a propensity to cleave the scissile peptide bond in PG in a highly site-specific manner. However, unlike UK and TPA, SK has no proteolytic activity of its own, and it activates PG to PN "indirectly" i.e. by first forming a high-affinity equimolar complex with PG, known as the activator complex (reviewed by Castellino, F. J., 1981). The activator complex then acts as a protease that cleaves other, substrate molecules of PG to PN.

Regardless of tremendous advances in therapeutic use of streptokinase and other bacterial thrombolytics, there are several shortcomings that limit the usefulness of these polypeptide drugs. These disadvantages include their susceptibility to degradation by proteolytic enzymes, short circulating half-life, short shelf-life, rapid kidney clearance and their propensity to generate neutralizing antibodies. These shortcomings are also sometimes inherent to many other polypeptide drugs that are non human in origin. This aspect in general is reviewed by Roberts et. al; 2002. Various attempts were made to overcome these short comings in polypeptide drugs, such as altering the amino-acid sequences to reduce proteolysis or antigenicity, fusing the polypeptides to globulin or albumin domains to improve half-life etc. (Osborn et. al., 2002). These methods provided little help to the problem and came along with associated burden. The major breakthrough in this area was method of protein PEGylation that provided single solution to multiple problems. PEG (Poly Ethylene Glycol) is formed by polymerizing number of repeating subunits of ethylene glycol to give rise to linear or branched PEG polymers of tailored molecular masses. Once covalently conjugated with PEG the protein or polypeptide shows improved pharmacokinetic and pharmacodynamic properties such as increased water solubility, decreased renal clearance and often substantially limited immune reactivity (Moreadith et. al., 2003, Doherty et al., 2005, Basu et. al., 2006). The PEG conjugation also makes the molecule proteolytically less susceptible. The decreased receptor interaction or interaction with cell surface proteins that follows the PEG addition also helps to reduce adverse immunological effects. PEGylated drugs are also more stable over a wide range of pH and temperature changes (Monfardini et al. 1995). Use of PEG is FDA approved for therapeutics and it shows virtually no toxicity and eliminated from the body intact by either kidneys or in faeces. The beneficial features of PEG conjugation can be potentially imparted to SK to make it a more effective and safer thrombolytic. Attempt of SK PEGylation is reported in literature (Rajagopalan et. al., 1985) using a relatively non-specific chemical modification reaction. The therapeutic uses of such modifications were severely limited by highly compromised plasminogen activation ability. Also the nature of modification was poorly defined and heterogeneous in nature. The region for this heterogeneity was the chemistry used for PEG modification that does not target modification of a specific site. This could be the reason why such modification strategy was not utilized for the development of improved SK based thrombolytics.

The term streptokinases used anywhere in the text collectively refers; variants of streptokinase, any of its functional fragments, functional muteins, isolates from different species and fusion products obtained through attachment of oligo or polypeptides of natural or artificial origin.

It is known that different functional groups present in a protein can be utilized for PEG introduction. The most commonly employed techniques are derivatization of lysine residues or cysteine residues in the protein. Alpha-amino group at the N-terminus can also be exploited for single homogenous conjugation of PEG in proteins (Baker et. al., 2006). However, the use of cysteine residues to bear the incorporated PEG groups is particularly advantageous since, potentially, the —SH groups can be targeted in a site-specific mode particularly if the protein bears or made to bear a very limited number of cysteine residues. It is not an exaggeration to state that PEG conjugation becomes an art form when the protein is devoid of any cysteine since it leaves a virtual blank canvass for cysteine addition, insertion or substitution for site-specific PEG "painting", or decoration, of proteins. Since potentially addition of cysteines into the cysteine free background can have adverse effects on the protein function. Therefore, the selection of sites for preparation of cysteine variants requires careful planning and execution. In contrast to, say, Lysine based modifications for PEGylation, although the chemistry is well defined, heterogeneity in reaction is a big disadvantage. In the case of SK, a large number of lysine residues are evenly spread all along the polypeptide and hence limit the possibility of homogenous site-specific PEG conjugation. More interestingly, there is no natural Cysteine present in the Streptokinase molecule (Malke et. al., 1985), thus making it possible to generate various Cysteine variants of streptokinase. Also there are no free cysteines in the natively folded covalent variants of SK derived by fusion with fibrin binding domains (ref. U.S. Pat. No. 7,163,817). This renders the possibility of making various free cysteine containing variants of Clot-specific streptokinase without actually interfering with the normal refolding of the cysteine-rich protein (all the cysteine residues being engaged in disulfide bond formation). The free Cysteine(s) introduced can be reacted with various thiol-reactive reagents including PEG to generate Cysteine adduct/s of these proteins.

Streptokinase (SK) is a generic name for a secretory protein produced by a variety of hemolytic streptococci that has the ability to induce lysis of plasma clots (Tillet and Garner, 1933). Because it can be easily and economically produced from its parent source, or through rDNA technology from suitable heterologous hosts, SK is very cost effective and thus is a major thrombolytic drug particularly for the cost-conscious markets world-wide. SK has been found very effective in the clinical treatment of acute myocardial infarction following coronary thrombosis (ISIS-3, 1992) and has served as a thrombolytic agent for more than three decades. However, it suffers from a number of drawbacks. It is known that the plasmin produced through the streptokinase mediated activation of plasminogen breaks down streptokinase soon after its injection (Rajagopalan et. al., 1985, Wu et. al., 1998). This limits the in vivo half-life of streptokinase to about 15 min (Wu et. al., 1998). Although streptokinase survives in circulation significantly longer than does another thrombolytic drug of choice, TPA (with a half-life less than 5 min; Ross, 1999; Ouriel, 2002), this is still short for efficient therapy (Wu et al., 1998). Because of the recognized shortcomings related to rapid in vivo clearance of the available plasminogen activators, attempts are underway to develop improved recombinant variants of these compounds (Nicolini et al., 1992, Adams et al., 1991, Lijnen et al., 1991; Marder, 1993, and Wu et al., 1998). Despite its inherent problems, streptokinase remains the drug of choice particularly in the developing countries because of its low relative cost (e.g., approximately US$ 50 or less per treatment compared to nearly US $ 1500 for TPA).

Streptokinase was first reported to cause lysis of blood clots by Tillet and Garner (1933). However, later it was established that the fibrinolytic activity of SK originates from its ability to activate human plasminogen (HPG), reviewed by Castellino, 1979). Streptokinase is mainly secreted by -hemolytic group A, C and G streptococci. SK is an activator of human PG though itself it is not a protease, rather it binds to human PG/PN and recruits other HPG molecules as substrate and converts these into product, PN. The latter circulates in the blood stream. Plasmin, being a non-specific protease, the generalized and immediate PN generation subsequent to SK injection results in large scale destruction of various blood factors leading to risk of hemorrhage, as also the dissolution of ECM and basement membrane (BM) and enhances bacterial invasiveness into secondary infection sites within the host body (Esmon and Mather, 1998; Lähteenmäki et al., 2001). Thus, there is an acute need to minimize the side-effects by designing improved SK analogs.

SK is currently being extensively used as a thrombolytic drug world wide since it is an efficient fibrin clot dissolver, yet it has its own limitations. SK being a protein produced from β hemolytic streptococci, its use in humans induces immunogenicity (McGrath and Patterson, 1984; McGrath et al., 1985; Schweitzer et al., 1991). The high titres of anti-SK immunoglobulins (Ig) generated after the first SK administration are known to persist in patients for several months to a few years (Lee et al., 1993). Thus, the anti-SK antibodies severely limit its use as future repeat therapy by either neutralizing SK upon administration (Spottal and Kaiser, 1974; Jalihal and Morris, 1990) or by causing a range of allergic reactions (McGrath and Patterson, 1984; McGrath et al., 1985).

As mentioned before, the use of streptokinase in thrombolytic therapy is hampered by the relatively short half-life (a few minutes) of this protein in vivo (which indeed is the case with all presently employed thrombolytic drugs), apart from its immunogenicity. It is observed that foreign proteins when introduced into the vertebrate circulation are often cleared rapidly by the kidneys. This situation becomes even more acute in case of streptokinase where progressively higher doses of the protein (to overcome antibody based rapid neutralization) can severely increase probability of allergic response/s, making the repeated administration essentially ineffective and dangerous. Attempts to solve these problems in general, are well documented in the literature where various physical and chemical alterations have been shown to be useful for generation of improved therapeutics, e.g. see: Mateo, C. et al 2000, Lyczak, J. B. & Morrison, S. L. 1994, Syed, S. et. al; 1997, Allen, T. M. 1997. The most promising of these to-date is the approach of modification of therapeutic proteins by covalent attachment of polyalkylene oxide polymers, particularly polyethylene glycols (PEG). PEG is a non-antigenic, inert polymer and is known to increase the circulating half-life of the proteins in the body (Abuchowski et al., 1984; Hershfield, 1987; Meyers et al., 1991). This allows the extended action of the drug in use. It is believed that PEG conjugation to proteins increases their overall size and hence reduces their rapid renal clearance. PEG attachment also makes the protein or polypeptide more water soluble and increases its stability under in vivo conditions along with markedly reducing immunogenicity and increasing in vivo stability (Katre et al., 1987; Katre, 1990). U.S. Pat. No. 4,179,337 discloses the use of PEG or polypropylene glycol coupled to proteins to provide a physiologically active non-immunogenic water soluble polypeptide composition.

Although the chemistry of PEG conjugation is mostly generic but strategic placement of PEG polymers in a therapeutic protein is of paramount importance to achieve successful outcomes. Availability of three dimensional structural information with functional hot spots earmarked through various solution studies, helps in designing mutational plan to keep the functionality intact.

The complete amino acid sequence of SK was determined by sequential Edman degradation analysis of SK fragments generated by cyanogen bromide and enzymatic methods (Jackson and Tang, 1982). The results established that the molecule of Mr 47,408 Da, contains 415 amino acids in a single polypeptide chain amino acid sequence.

The nucleotide sequence from *S. equisimilis* H46A (the prototype strain for SK production that is most often used therapeutically in humans) was sequenced by Malke and co-workers, in 1985. The transcriptional control of this gene has also been studied and the functional analysis of its complex promoter has been reported (Grafe et al., 1996). Considerable information exists, therefore, for effectively using this gene in producing streptokinase safely in relatively non-pathogenic microbes.

SUMMARY OF THE INVENTION

Accordingly, the present invention provides mutants of streptokinase, its functional fragments or covalently modified forms. The variants comprise polypeptides related to SK where one or more Cysteine residues are substituted for one or more non-essential amino-acids of the proteins. Preferably the variants comprise a Cysteine residue substituted for an amino-acid selected from amino-acids in the loop regions, the ends of the alpha helices and even in the secondary structure-forming regions, or regions wherein the Cysteine residue is added at the N-terminus or C-terminus of the proteins with or without added amino acid extensions.

The present invention involves the general methods for the selection, production and use of streptokinases that show increased proteolytic stability, extended plasma elimination half-life and reduced immunogenicity. The derivatives have modified amino-acid sequences but retain their biological activity effectively. The invention also describes cysteine variants of Streptokinases that are covalently attached to one or more molecules of polyethylene glycol (PEG) of various molecular weights such as at least about 0.1, 0.2, 0.3, 0.4, 0.5, 0.6, 0.7, 0.8, 0.9, 1, 2, 3, 4, 5, 6, 7, 8, 9, 10, 12, 14, 16, 18, 20, 22, 24, 26, 28, 30, 32, 34, 36, 38, 40, 45, 50, 55, 60, 65 or 70 kDa, or more. Of course, any of the indicated weights above can serve as a lower and upper limit to a range of molecular weights. For example, the PEG used in the present invention may have a molecular weight of between about 1 kDa and about 2 kD, or between about 1 kDa and about 3 kDa, or between about 2 kDa and about 6 kDa, etc. One of the embodiments of the present invention encompasses pharmaceutical compositions of the PEGylated Streptokinase derivatives together with suitable excipients, stabilizers, and carriers as are known in the art for effective dissemination in the body for the treatment of diverse circulatory disorders.

The present invention relates to covalent attachment of PEG to cysteine variants of streptokinase, its muteins, species variants or fibrin fusion products, using thiol reactive PEG reagents. One can also use the different pKa value of alpha amine groups to carry out alpha-amine specific PEG conjugation at acidic pH to generate mono-PEGylated derivatives of streptokinase or its muteins.

The present invention also relates to identifying various Cysteine variants of Streptokinase, or its mutants including related covalent variants on the basis of structural and functional information (Wang et al., 1998). Structural comparison of other one domain plasminogen activator, staphylokinase (SAK) shows strong similarity with SK alpha domain although the two have no significant sequence homology at amino-acid level (Rabijns et. al., 1997). This indicates that plasminogen activators from different sources retain the same structural fold even if they differ much in their polypeptide sequence. The evolutionary constrain to keep the structural integrity is expected because bacterial plasminogen activators are protein cofactors, therefore utilize multiple contact points required for conformational activation of zymogen. Such structural similarity extends the scope of this invention further because the methods practiced in this case can be applied to bacterial plasminogen activators from other genre or species that share the similar plasminogen activation domains. For this reason, the "rules" disclosed herein for creating biologically active cysteine variants of streptokinase will be useful for creating biologically active cysteine variants of various other forms of streptokinase. Conjugation of these cysteine variants with cysteine-reactive PEGs will impart similar benefits as obtained with the variants used in this study. The rules for determining the site of Cysteine placement was largely based on the idea to choose from the surface exposed residues falling either in the loop or helix or the sheets or in the boundaries of structural and flexible regions. To determine the surface accessibility DSSP program was used. The DSSP (Kabsch et al., 1983) program defines secondary structure, geometrical features and solvent exposure of proteins, given atomic coordinates in Protein Data Bank format. DSSP states each residue's exposure in terms of square Ångstroms. Surface accessibility of the streptokinase amino-acid residues were deciphered from high resolution crystal structure of streptokinase in complex of microplasmin (Wang et. al. 1998, PDB ID 1BML). For the regions that were missing in this structure (175-181 and 252-262) crystal structure of the isolated beta domain (Wang et. al., 1999, PDB ID 1c4p) was used for determination of surface exposure.

Cysteine variants of streptokinase its muteins, species variants and its covalently modified forms were further chemically modified by attaching sulfhydryl reactive reagents, followed by empirical testing for substantial retention of biological activity along with gain in new properties such as reduced immunogenicity, or reaction with anti-SK antibodies, reduced proteolytic susceptibility, increased in vivo survival etc. More particularly, the invention relates to production of engineered streptokinase derivatives for use in pharmaceutical compositions for treating circulatory disorders.

The thiol so generated at C-termini (C-CYS) has been cross-linked with methoxy-PEG maleimide of 20 KDa to give protein-PEG adduct of higher molecular weight. Panel D shows the bi-pegylated variant of streptokinase (SEQ ID NO: 491), where cysteine has been placed one each at both N and C-terminus of the original sequence of streptokinase. The double cysteine mutant so generated has been modified with PEG of molecular weight 20 KDa.

Figure 2:
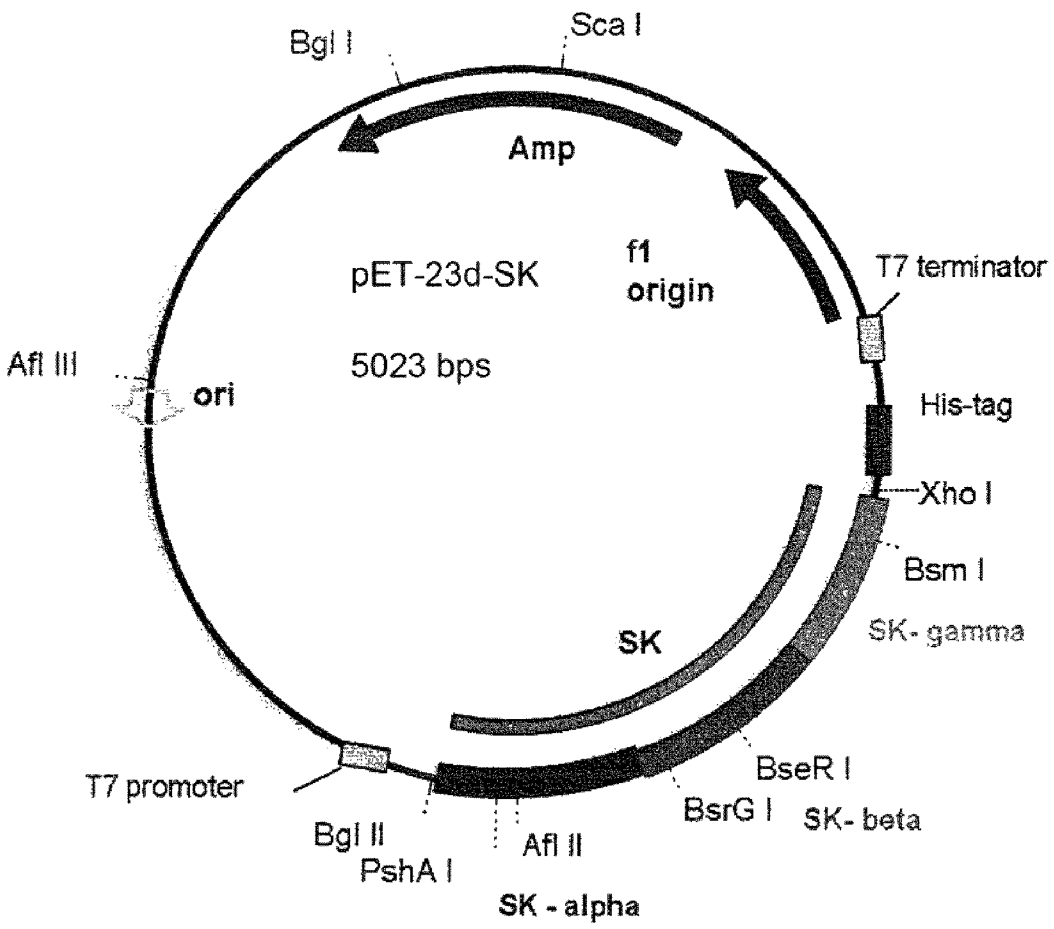

FIG. 2 depicts the circular map of pET-23d-SK, the expression vector employed for the expression of streptokinase in *E. coli*. The circular map highlights a few selected, unique RE sites on the pET-23d vector, a T7-RNA polymerase promoter-based expression vector (Studier et al., 1990) and the incorporated gene encoding for SK that was used for the construction and expression of SK and its muteins.

Figure 3:
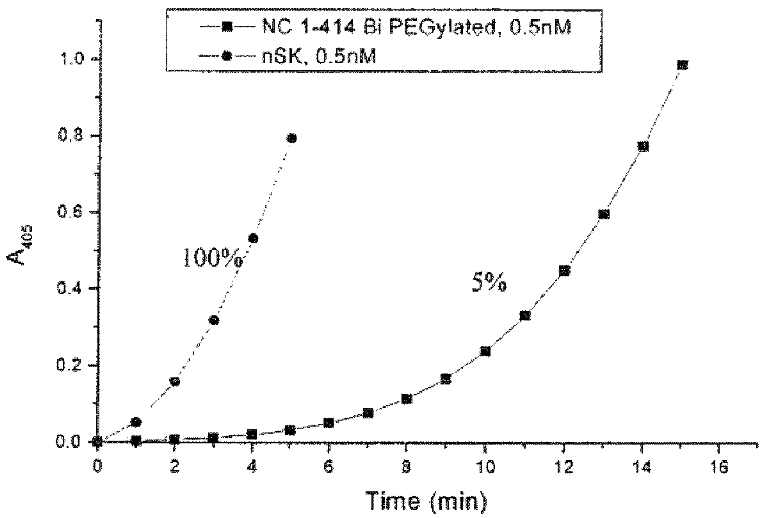

FIG. 3 depicts the spectroscopically obtained progress curves of HPG activation by nSK and bi-pegylated streptokinase variant NC 1-414 (SEQ ID NO: 491). Noticeably, the progress curves show significant lag in the ability to activate plasminogen for bi-pegylated NC 1-414 but not in case of nSK.

Figure 4:
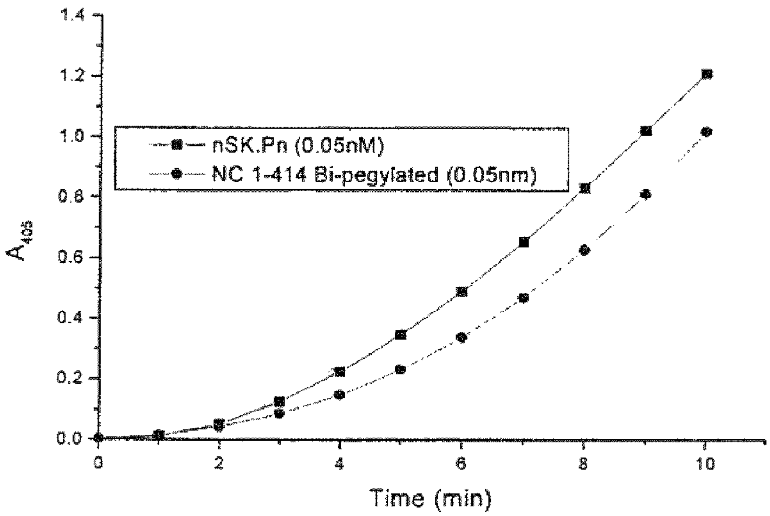

FIG. 4 depicts progress curves of HPG activation by equimolar complex of nSK or bi-PEGylated NC 1-414 (SEQ ID NO: 491) with human plasmin. The use of preformed complex of bi-PEGylated streptokinase NC 1-414 with plasmin abolishes the time lag seen in FIG. 3, and thus establishes the plasmin dependency for normal plasminogen activation ability by the PEGylated SK which is in contrast to nSK which does not show a lag irrespective of the absence/presence of plasmin in the reaction.

DETAILED DESCRIPTION OF THE INVENTION

The main object of the present invention is to provide mutants of streptokinase with potential for increased efficacy due to extended action and reduced immuno-reactivity.

Another object of the present invention relates to novel mutants of Streptokinase, its functional fragments and covalently modified forms.

Another object of the invention is to provide methods for the preparation of the bacterial plasminogen activator protein, Streptokinase its muteins, species variants and their covalently modified variants that are characterized by improved therapeutic properties, such as increased proteolytic stability, extended plasma half-lives, reduced immuno-reactivity and enhanced fibrin clot specificity. The methods involve either incorporating additional cysteine residues, or substituting cysteine residues for naturally occurring amino acids into non-essential regions of the protein such that the catalytic activity of the resultant protein remains largely unaltered.

Yet another object of the present invention is to provide a method for the production of PEGylated cysteine variants of streptokinase or its active muteins or the hybrid plasminogen activator molecules in pure and biologically active form.

Yet another object of the present invention is to provide a mutant streptokinase polypeptide comprising from one to three cysteine substitutions, wherein the cysteine substitution is located acid in at least one region corresponding to the native amino acid sequence of Streptokinase (SEQ ID NO: 1), the region being selected from the group consisting of the loop of amino acid residues 48-64, the loop of amino acid residues 88-97, the region of amino acid residues 102-106, the region of amino acid residues 119-124, the helix forming region of amino acid residues 196-207, the loop forming region of amino acid residues 170-181, the loop forming region of amino acid residues 254-264, the coiled coil region of amino acid residues 318-347 and the region of amino acid residues 360-372, wherein the mutant can activate plasminogen.

In another embodiment the mutant streptokinase comprises at least one amino acid substitution, the amino acid substitution corresponding to an amino acid substitution being selected from the group consisting of Asn90Ala, His107Ala, Ser108Ala, Asp227Tyr, Asp238Ala, Glu240Ala, Arg244Ala, Lys246Ala, Leu260Ala, Lys278Ala, Lys279Ala and Asp359Arg of SEQ ID NO:1.

In another embodiment the mutant streptokinase comprises at least one cysteine mutation at a position corresponding to G49, S57, A64, I88, S93, D95, D96, D102, S105, D120, K121, D122, E148, K156, D173, D174, L179, D181, S205, A251, I254, N255, K256, K257, S258, L260, E281, K282, F287, D303, L321, L326, A333, D347, D360 or R372 of SEQ ID NO:1.

In another embodiment the mutant streptokinase comprises at least two cysteine mutations at a position corresponding to G49, S57, A64, I88, S93, D95, D96, D102, S105, D120, K121, D122, E148, K156, D173, D174, L179, D181, S205, A251, I254, N255, K256, K257, S258, L260, E281, K282, F287, D303, L321, L326, A333, D347, D360 or R372 of SEQ ID NO:1.

In another embodiment the mutant streptokinase comprises at least three cysteine mutations at a position corresponding to G49, S57, A64, I88, S93, D95, D96, D102, S105, D120, K121, D122, E148, K156, D173, D174, L179, D181, S205, A251, I254, N255, K256, K257, S258, L260, E281, K282, F287, D303, L321, L326, A333, D347, D360 or R372 of SEQ ID NO:1.

In another embodiment the mutants, further comprise a fibrin binding domain fused to the C-terminus, the N-terminus or both termini. In another embodiment, the fibrin binding domain is connected to the mutant streptokinase via a flexible connecting oligopeptide.

In another embodiment the mutants comprising a fibrin-binding domain comprise at least one cysteine substitution in the fibrin binding domain.

In another embodiment the mutant streptokinase comprises a deletion, the deletion corresponding to an amino acid deletion being selected from the group consisting of Asn90, Asp227 and Asp359 of SEQ ID NO:1.

Yet another object of the present invention is to provide a fusion polypeptide, the fusion polypeptide comprising a streptokinase domain and a fibrin binding domain, the streptokinase domain comprising from one to three cysteine substitutions, wherein the cysteine substitution is located in the fibrin binding domain or at least one region corresponding to the native amino acid sequence of Streptokinase (SEQ ID NO: 1), the region being selected from the group consisting of the loop of amino acid residue 48-64, the loop of amino acid residues 88-97, the region of amino acid residues 102-106, the region of amino acid residues 119-124, the helix forming region of amino acid residues 196-207, the loop forming region of amino acid residues 170-181, the loop forming region of amino acid residues 254-264, the coiled coil region of amino acid residues 318-347, and the region of amino acid residues 360-372 of SEQ ID NO: 1, wherein the mutant can activate plasminogen and bind fibrin.

In another embodiment, the mutant streptokinase comprises at least one cysteine mutation selected from the group consisting of H16, A17, D62, G80, G166, S157, A181, I205, S210, D212, D213, D219, D222, D237, K238, D239, E265, K273, D290, D291, L296, D298, S322, I371, N372, K373, K374, S375, L377, E398, K399, F404, D420, L438, L443, A450, D464, D477 and R489 of SEQ ID NO:22.

In another embodiment, the mutant streptokinase comprises at least one cysteine mutation selected from the group consisting of G49, S57, A64, I88, S93, D95, D96, D102, S105, D120, K121, D122, E148, K156, D173, D174, L179, D181, S205, A251, I254, N255, K256, K257, S258, L260, E281, K282, F287, D303, L321, L326, A333, D347, D360, R372, H401, A402, D447 and G465 of SEQ ID NO:23.

In another embodiment, the mutant streptokinase comprises at least one cysteine mutation selected from the group consisting of H16, A17, D62, G80, G166, S157, A181, I205, S210, D212, D213, D219, D222, D237, K238, D239, E265, K273, D290, D291, L296, D298, S322, I371, N372, K373, K374, S375, L377, E398, K399, F404, D420, L438, L443, A450, D464, D477, R489, H518, A519, D564 and G582 of SEQ ID NO:24.

In another embodiment the mutant streptokinases further comprise an N and/or C-terminus extension of amino acids.

In another embodiment the mutant streptokinases can be used in conditions associated with thrombosis. For example, the mutant streptokinases can be used to treat a disease or disorder selected from the group consisting of myocardial infarction, vascular thromboses, pulmonary embolism, stroke, a vascular event, angina, pulmonary embolism, transient ischemic attack, deep vein thrombosis, thrombotic re-occlusion subsequent to a coronary intervention procedure, peripheral vascular thrombosis, heart surgery, vascular surgery, heart failure, Syndrome X and a disorder in which a narrowing of at least one coronary artery occurs.

In another embodiment the mutant streptokinases further comprise a cysteine-reactive moiety substituted on at least one of the cysteine mutants. In another embodiment the cysteine-reactive moiety is polyethylene glycol (PEG). In another embodiment the PEG is a linear or branch polymer of molecular size ranging from 5000 daltons-40,000 daltons.

In another embodiment the mutant streptokinases comprising PEG have increased proteolytic stability, compared to an un-PEGylated mutant streptokinase. In another embodiment, the mutant streptokinases comprising PEG have decreased antigenicity and decreased in vivo immunogenicity, compared to an un-PEGylated mutant streptokinase. In another embodiment the mutant streptokinases comprising PEG have slow renal clearance and increased in vivo half life, compared to an un-PEGylated mutant streptokinase.

The present invention is based on the experimental findings that covalent attachment of one or more molecules of PEG to the strategically substituted or added cysteine residues in the streptokinase results in a biologically active, PEGylated streptokinase with increased proteolytic stability and extended elimination half-life along with reduced clearance, and lesser immune reactivity when compared to native streptokinase. The site and size of PEG conjugation can be tailor-made with the help of cysteine variants designed to be non-inhibitory to catalytic function (plasminogen activation) in the streptokinase and its active variants, including clot-specific streptokinases (reference in this context may be made to U.S. Pat. No. 7,163,817 which describes the design and construction of clot-specific streptokinase variants with increased fibrin affinity due to the addition of fibrin binding domains to either, or both, ends of the SK protein). Substitution, addition or insertion of one or more cysteine/s in the streptokinase and clot-specific streptokinase polypeptides makes it convenient to add PEG of different molecular masses to the desired location of the polypeptide provided the substitutions and or additions are carried out in a "strategic" manner that cleanly avoids loss of functional characteristics, and result in the generation of new beneficial properties not present in the unmodified native protein. The choice of PEG placement was designed on the basis of surface accessibility of the selected site and its structure-function relevance.

The PEGylated streptokinases of the present invention have greater usefulness as therapeutics as well as greater convenience of use compared to the native molecule(s) because while retaining native or near-native like biological activity, they exhibit an extended time-action when compared to the former, which degrade rapidly in vitro in the presence of plasmin(ogen), as well as after injection as a result of which these are cleared from the circulation in a very short time. In contrast, the PEGylated streptokinases exhibit significantly enhanced proteolytic stability, are less immuno-reactive, and are cleared from the circulation in vivo only after markedly extended durations as compared to the native (nonPEGylated) proteins.

Therefore, PEGylated streptokinases of the present invention are useful to treat subjects with circulatory disorders such as venous or arterial thromboses, myocardial infarction etc, with the advantages being that the PEGylated streptokinases of the invention present the potential for increased efficacy due to extended action and reduced immuno-reactivity, that allows the possibility of repeated administration due to their minimal antigenicity. The number, size and location of PEG group/s can be employed in such a way so as to redesign the Streptokinases to possess differential half-lives so to make their use conducive to the requirement of a particular disorder/clinical syndrome, or a particular subject under treatment.

The present invention involves the selective modification of streptokinases for pharmaceutical use, to both enhance its pharmacokinetic properties and provide therapeutically useful thrombolytics. This invention also include mutants of streptokinase its natural or artificial variants that retain desirable biological properties of the native unmodified molecule. All variants of this invention may be prepared by expressing recombinant DNA sequences encoding the desired variant in host cells, e.g. prokaryotic host cells such as *E. coli*, or eukaryotic host cells such as yeast or mammalian cells, using conventionally used methods and materials known in the art. DNA sequence information for encoded streptokinase from different species may be obtained from published information. Polymorphism of the streptokinase gene has been studied and their implications for the pathogenesis are explained (Malke H, 1993). A molecular epidemiological study has also been conducted to determine the distribution of the streptokinase gene in group A streptococcal strains of different M types and in other streptococcal species. Most of the strains examined in this study show positive streptokinase activity by the casein-plasminogen overlay assay. The overall results of these studies indicate that there is considerable heterogeneity among the streptokinases obtained from different streptococcal species (Huang et. al; 1989). It is possible to use any of available streptokinase variant that has plasminogen activation ability for cysteine mutagenesis and subsequent modifications with sulfhydryl reactive agents.

The new DNA sequences encoding mutants and species variants can be similarly cloned and expressed as in case of natural forms. The streptokinases produced by expression in the genetically engineered host cells may then be purified, and if desired formulated into pharmaceutical compositions by conventional methods.

As a preferred aspect of this invention, the streptokinases expressed by recombinant means are reacted with the desired thiol reactive agents under conditions that allow attachment of the thiol reactive moiety to the sulfhydryl group of the introduced cysteine residues in the streptokinases.

The term thiol reactive is defined herein as any compound having, or capable of being activated to have, a reactive group capable of forming a covalent attachment to the sulfhydryl group (—SH) of the cysteine residue. Included among such compounds are polymers such as polypropylene glycol and PEG, carbohydrate based polymers and polymers of amino-acids and biotin derivatives. Compound need to be conjugated can be activated with a sulfhydryl moiety, such as sulfhydryl group, thiol, triflate, tresylate, aziridine or oxiran, or preferably, iodoacetamide or maleimide. The conjugating group may have various molecular weights but preferably between 5000 and 40,000 for the PEG. One of the important attributes of the present invention is to confer positional selectivity of the PEGylation or other attachments while preserving the normal functional properties of the protein.

Accordingly, the present invention provides a mutant streptokinase polypeptide having amino acid sequence selected from the group consisting of SEQ ID NO: 1-24, wherein at least one cysteine residue is substituted or inserted. Table 34 shows residues that correspond to residues of SEQ ID NO:1 that are likely intolerant to mutation or substitution.

In an embodiment of the present invention, the mutant of streptokinase prepared is a functional fragment of streptokinase having SEQ ID NO: 2-6.

In an embodiment of the present invention, the mutants of streptokinase prepared are muteins of streptokinase having SEQ ID NO: 7-19.

In an embodiment of the present invention, the mutant of streptokinase prepared are species variants of streptokinase having SEQ ID NO: 20-21.

In an embodiment of the present invention, the species variants of streptokinase show 75%-100% amino acid sequence homology with the native streptokinase having SEQ ID NO: 1.

In another embodiment of the present invention, at least one cysteine residue is substituted for at least one amino acid located in at least one region of Streptokinase selected from the group consisting of: the 48-64 loop, 88-97 loop, the region 103-106, or 119-124 or the helix forming region 196-207 or the loop forming region 170-181 or the loop forming region 254-264 or the coiled coil region 318-347 or the region 360-372 of SEQ ID NO: 1 or its muteins or their functional fragments, wherein said variant has biological activity as measured by a standard assay.

As used herein, the term corresponding to is used to mean enumerated positions within the reference protein, e.g., wild-type Streptokinase (SK) or SEQ ID NO:1, and those positions in the queried protein (e.g. a mutant SK) that align with the positions on the reference protein. Thus, when the amino acid sequence of a subject SK, e.g., SEQ ID NOs: 2, 3, 4, 5, etc., is aligned with the amino acid sequence of a reference SK, e.g., SEQ ID NO:1, the amino acids in the subject SK sequence that “corresponds to” certain enumerated positions of the reference SK sequence are those that align with these positions of the reference SK sequence, but are not necessarily in these exact numerical positions of the reference SK sequence. For example, a Gly34Cys mutant in SEQ ID NO:4 would “correspond to” a Gly49Cys mutant in SEQ ID NO:1.

In yet another embodiment of the present invention SEQ ID NO: 22-24 are covalently modified hybrid polypeptide comprising of at least one functional fragment of streptokinase (SK) and fibrin binding domains 4 and 5, fibrin binding domains (FBDs) 1 and 2 of human fibronectin.

In yet another embodiment of the present invention, the functional fragment of SK and said fibrin binding domains are connected via a flexible connecting oligopeptide.

In yet another embodiment of the present invention, the mutant described above comprises an N and/or C-terminus extension of amino acids.

In yet another embodiment of the present invention, a cysteine residue is substituted for at least an amino acid selected from the group consisting of: G49, S57, A64, I88, S93, D95, D96, D102, S105, D120, K121, D122, E148, K156, D173, D174, L179, D181, S205, A251, I254, N255, K256, K257, S258, L260, E281, K282, F287, D303, L321, L326, A333, D347, D360, R372, wherein said variant has biological activity as measured by a standard assay.

In yet another embodiment of the present invention, a cysteine residue is substituted for at least an amino acid selected from the group consisting of: H16, A17, D62, G80, G166, S157, A181, I205, S210, D212, D213, D219, D222, D237, K238, D239, E265, K273, D290, D291, L296, D298, S322, I371, N372, K373, K374, S375, L377, E398, K399, F404, D420, L438, L443, A450, D464, D477, R489, of the SEQ ID NO. 22, wherein said variant has biological activity as measured by a standard assay.

In yet another embodiment of the present invention, a cysteine residue is substituted for at least an amino acid selected from the group consisting of: G49, S57, A64, I88, S93, D95, D96, D102, S105, D120, K121, D122, E148, K156, D173, D174, L179, D181, S205, A251, I254, N255, K256, K257, S258, L260, E281, K282, F287, D303, L321, L326, A333, D347, D360, R372, H401, A402, D447, G465, of the SEQ ID NO. 23, wherein said variant has biological activity as measured by a standard assay.

In yet another embodiment of the present invention, a cysteine residue is substituted for at least an amino acid selected from the group consisting of: H16, A17, D62, G80, G166, S157, A181, I205, S210, D212, D213, D219, D222, D237, K238, D239, E265, K273, D290, D291, L296, D298, S322, I371, N372, K373, K374, S375, L377, E398, K399, F404, D420, L438, L443, A450, D464, D477, R489, H518, A519, D564, G582 of the SEQ ID NO. 24 which has biological activity as measured by a standard assay.

In yet another embodiment of the present invention, the substituted cysteine residue is modified with a cysteine-reactive moiety.

In yet another embodiment of the present invention, substituted cysteine residue is modified with polyethylene glycol.

In yet another embodiment of the present invention, the PEG molecule stated above is a linear or branch polymer of molecular size ranging from 5000 daltons-40,000 daltons.

In yet another embodiment of the present invention, the variant described above has increased proteolytic stability as compared to their original unmodified counterparts.

In yet another embodiment of the present invention, the above described variant has decreased antigenicity and in vivo immunogenicity when compared to their original unmodified counterparts.

In yet another embodiment of the present invention, the above described variant has slow renal clearance hence increased in vivo half life as compared to their original unmodified counterparts.

In yet another embodiment of the present invention, the pharmaceutical composition comprises at least one of the cysteine variants optionally along with pharmaceutically acceptable excipient(s).

In yet another embodiment of the present invention, the pharmaceutical composition is useful for treating disease or disorder selected from the group consisting of myocardial infarction, vascular thromboses, pulmonary embolism, stroke a vascular event, angina, pulmonary embolism, transient ischemic attack, deep vein thrombosis, thrombotic re-occlusion subsequent to a coronary intervention procedure, peripheral vascular thrombosis, heart surgery or vascular surgery, heart failure, Syndrome X and a disorder in which a narrowing of at least one coronary artery occurs.

Particularly the present invention features PEGylated cysteine variants of streptokinase or its muteins, or of a hybrid plasminogen activator comprising a polypeptide bond union between streptokinase (SK), or modified forms of SK, or suitable parts thereof, which are capable of plasminogen (PG) activation, with fibrin binding regions of human fibronectin selected from the fibrin binding domains of human fibronectin (e.g. the pair of domains 4 and 5, or domains 1 and 2, or modified forms thereof), so that the hybrid plasminogen activators possess the ability to bind with fibrin independently and thereby become clot specific due to their enhanced affinity for the substance of the blood clot, namely fibrin (U.S. Pat. No. 7,163,817).

It provides mono- or bi- or multi-PEGylated Cysteine variant/s of streptokinase or its truncated forms that are not only active with respect to PG activation capability, but exhibit a new and unexpected functional attribute. For example, the bi-PEGylated cysteine variant of SK where additional cysteines are placed at the two extremities of the polypeptide i.e. at the N- and C-termini, exhibits an unexpected property in respect to its human plasminogen activation characteristics, in that it has a markedly slower initial rate of activation of plasminogen (PG) compared to unmodified SK, but becomes fully capable of activating plasminogen in a manner similar to that of unmodified SK after an initial lag of several minutes' duration when assayed for PG activation in vitro. The inability to be self-activated immediately (as is the case with native, unmodified SK which activates PG virtually upon contact) is due to a plasmin-dependent mode of its action. In contrast, native SK does not require any plasmin to be activated, but is activated virtually as soon as it complexes with PG. Thus, after injection into the body, such a SK variant will make its voyage through the vascular system while still in an inactive, or partially active, state. However, it will preferentially become activated in the immediate vicinity of the clot the moment it contacts the clot, which is known to be plasmin-rich whereas the general circulation is not (free plasmin being rapidly inactivated in the 'open' circulation due to the presence of plasmin-specific Serpins [serine protease inhibitors] such as alpha-2-antiplasmin and alpha-2-macroglobulin), thereby obviating or significantly minimizing the systemic PG activation coincident with natural SK administration which immediately activates PG upon administration with consequent side-effects such as hemorrhage and large scale destruction of various protein components of the vascular system. This property i.e. plasmin-dependant activation, along with the extended elimination half-life, and low immunogenic and antigenic reactivity would result in not only an overall diminished generation of free plasmin in the general circulation but also the ability for the thrombolytic to be administered repeatedly for various circulatory maladies in a relatively lower dose while avoiding unwanted immune reactions. The net result shall be a continued and more efficient fibrinolysis at the target sustained by considerably lowered therapeutically effective dosages of the thrombolytic agent with minimized side-effects such as lowered immune reactivity, and mitigation of hemorrhagic complications often seen with normal SK.

The invention provides PEGylated cysteine variants of streptokinase or its muteins or of a hybrid plasminogen activator comprising a polypeptide bond union between streptokinase (SK), or modified forms of SK, or suitable parts thereof that show an in vitro biological activity that is comparable to that of native streptokinase as measured by plasminogen activation assays, the activity decrease if it occurs in some cases being well compensated by the derivative's extended half-life and/or lower clearance rates.

The invention provides PEGylated cysteine variant(s) of streptokinase that show characteristics of plasminogen activation only after a lag period of more than 5 minutes after exposure of the plasminogen activator to a suitable animal or human plasminogen.

The invention provides prokaryotic or eukaryotic cells, transformed or transfected with expression vectors in which gene to express streptokinase its muteins or covalently modified forms are cloned, and capable of expressing cysteine variants of streptokinase or its muteins or the hybrid plasminogen activators. For efficient expression, the DNA sequences encoding the streptokinase its muteins and covalently modified forms were optimized for codon preferences of bacterial or yeast based expression hosts.

The invention details out a method for the production of PEGylated cysteine variants of streptokinase or its active muteins or the hybrid plasminogen activator molecules in pure and biologically active form for clinical and research applications.

The invention takes into account the PEGylation of those cysteine variants that use template polynucleotide wherein the SK-encoding polynucleotide utilized for expression of SK, is modified, by mutagenesis by known biochemical or chemical DNA synthesis techniques, or their combination such that the plasminogen activator activity is retained.

The invention takes into account cysteine variants of SK or its truncated form/s that are PEGylated but also possess additional fibrin binding domains fused through polypeptide linkages so that the resultant chimeras/fusion polypeptides besides showing plasminogen activation capabilities, also show fibrin binding characteristics. The fusions between the fibrin binding domains and SK can be direct, but may also be through short linker peptide region/s comprising of a stretch of amino acid sequence that is not conformationally rigid but is flexible, such as those predominantly composed of Gly, Ser, Asn, Gln and similar amino acids.

The cysteine variants of SK or its muteins or covalently modified forms are expressed in *E. coli* using standard plasmids under the control of strong promoters, such as tac, trc, T7 RNA polymerase and the like, which also contain other well known features necessary to engender high level expression of the incorporated open reading frame that encodes for the SK or its muteins or covalently modified SK constructs.

The cysteine variants of SK or its muteins or species variants or covalently modified forms are expressed in yeast expression system using standard plasmids wherein the N-terminal signal peptide is optimized for efficient extracellular secretion of the mature polypeptide. The sequence information for these signal peptides can be obtained from the secretory proteins of yeast expression system. Additionally such information can also be obtained from the other recombinant proteins that are hyper secreted and contain an optimized signal sequence.

The invention provides a method wherein the crude cell-lysates obtained, using either chemical, mechanical or enzymatic methods, from cells harboring the single, double or triple cysteine variants of SK or SK chimeric polypeptides are subjected to air or thiol-disulfide reagent catalytic oxidation, or enzyme catalyzed thiol-disulfide oxidative refolding to refold to their biologically active conformations containing the native cysteine pairing (in covalently modified forms of SK) while leaving the additional cysteine(s) free for sulfhydryl reactive chemical modifications.

The invention provides a method wherein the crude cell-lysates obtained, using either chemical, mechanical or enzymatic methods, from cells harboring the single, double, triple or multiple cysteine variants of covalently modified forms of SK, are subjected to oxidation and refolding using a mixture of reduced and oxidized glutathione, or other such reagents as are useful for such oxidative folding reactions through thiol-disulfide interchange e.g. cysteine and cystine, of a suitable redox potential that allows the covalently modified forms of SK to refold to their biologically active conformations while leaving the additional cysteine(s) free for sulfhydryl reactive chemical modifications.

The cysteine variants of SK its muteins or covalently modified forms are expressed in eukaryotic organisms such as yeasts or animal or plant cells using standard genetic methods either as incorporated genetic units in the main genomes, or as autonomous genetic elements well known in the field so as to obtain high level expression of the incorporated open reading frame/s that encode for the SK or its muteins or covalently modified SK constructs.

The invention provides a method wherein a PEGylated cysteine variant of SK or SK chimeric plasminogen activator protein can be used as a thrombolytic therapy or prophylaxis for various vascular thromboses. The activator may be formulated in accordance with routine procedures as pharmaceutical composition/s adapted for administration to human beings, and may include, but are not limited to, stabilizers such as human serum albumin, mannitol etc, solublizing agents, or anesthetic agents such as lignocaine and the like, as well as other agents or combinations thereof that stabilize and/or facilitate delivery of the variants in vivo.

The invention provides a pharmaceutical composition comprising PEGylated Cysteine variants of SK or hybrid plasminogen activator and stabilizers that include, but are not limited to, human serum albumin, mannitol etc, and solublizing agents, anesthetic agents etc.

The present invention will be explained in more detail in the following examples that are, however, not intended to limit the scope of the invention. Taking cognizance of the present invention other variants, combinations and improvements will be obvious for the person skilled in the art. Thus, similar work or its careful imitations are likely to generate similar or improved features even in other variants of streptokinase that are not disclosed in this invention and belong to different isolates of human or non-human origin.

EXAMPLES

General Methods used in Examples

In general, the molecular methods and techniques well known in the area of molecular biology and protein science were utilized. These are readily available from several standard sources such as texts and protocol manuals pertaining to this field of the art, for example, Sambrook et al., Molecular Cloning: A Laboratory Manual (II.sup.nd edition, Cold Sparing Harbor Press, New York, 1989; McPherson, M. J., Quirke, P., and Taylor, G. R., [Ed.] PCR: A Practical Approach, IRL Press, Oxford, 1991, Current Protocols in Protein Science, published by John Wiley & sons, Inc. For immunological experiments text and protocol manuals from Immunochemical Protocols, Hudson L, Hay F C (1989) 3rd ed. Blackwell Scientific was referred.

This however does not limits the detailed explanation in the context of specific experiments describing the present invention, particularly where modifications were introduced to established procedures, are indicated in the Examples whenever relevant.

Reagents

The cloning of SK gene was done in the T7 RNA polymerase promoter-based expression vector, pET-23d and was transformed in the *Escherichia coli* BL21 (DE3) strain procured from Novagen Inc. (Madison, Wis.). Thermostable DNA polymerase (Pfu), restriction endonucleases, T4 DNA ligase and other DNA modifying enzymes were acquired from New England Biolabs (Beverly, Mass.). Oligonucleotide primers were supplied by one of these; Biobasic, Inc., Canada, Integrated DNA technologies, US, or Sigma-Aldrich, US. Purifications of DNA and extraction of PCR amplified products from agarose gels were performed using kits available from Qiagen GmbH (Germany). Automated DNA sequencing using fluorescent dyes was done on Applied Biosystems 3130x1 genetic analyzer 16 capillary DNA sequencer. Glu-plasminogen was either purchased from Roche Diagnostics GmbH (Penzberg, Germany) or purified from human plasma by affinity chromatography (Deutsch and Mertz, 1970). The N-terminal amino acid sequencing was done with Applied Biosystems sequencer, Model 476A and 491 clc. Urokinases, EACA, sodium cyanoborohydride, L-Lysine were purchased from Sigma Chemical Co., St. Louis, USA. Phenyl Agarose 6XL and DEAE Sepharose (Fast Flow) were procured from Pharmacia Biotech, Uppsala, Sweden, while, Ni-NTA beads were from Qiagen. All other reagents were of the highest analytical grade available.

Casein-plasminogen overlay for detection of SK activity: Activity of different SK derivatives were detected by overlay of casein and human Plasminogen in soft agar. The original method of Malke and Ferretti, 1984; was modified where purified SK (0.5 microgram) was directly spotted on marked depressions on LB-Amp agar plates. The plate was then incubated at 37° C. for 10 minutes; thereafter, casein-HPG-agarose was overlaid by gently pouring the mixture of solutions A and B on top of the plate containing the spots. Solution A was prepared by heating 1 g of skim milk in 15 ml of 50 mM Tris, Cl (pH 7.5), after which it was maintained at 37° C. in a water-bath till further use. Solution B was prepared by heating 0.38 g of agarose in 15 ml of 50 mM Tris. Cl (pH 7.5) at 50° C. After tempering the solution to 37° C., 3 μl of TritonX-100 (0.04% v/v) and 200 μg HPG was added. The plate was then incubated at 37° C. and observed for the generation of zones of clearance (halo formation) due to casein hydrolysis, following HPG activation.

For proteolytic stability, each PEGylated derivative and the native SK was incubated with proteolytic enzymes such as trypsin or plasmin. Protease concentrations used in the reaction were varied from 500-10,000 fold of the protein concentration. The reactions were kept under shaking condition at 25° C. for two to four hours. Same amount of trypsinized protein for both test and control were spotted on the LB-Amp agar plates and the residual activity was measured after Casein-plasminogen overlay of the plates.

SDS-PAGE analysis of proteins: SDS-PAGE is carried out, essentially according to Laemmli, U. K., 1970, with minor modifications, as needed. Briefly, protein samples are prepared by mixing with an equal volume of the 2.times.sample buffer (0.1 M Tris Cl, pH 6.8; 6% SDS; 30% glycerol; 15% beta-mercaptoethanol and 0.01% Bromophenol Blue dye). For non-reducing SDS-PAGE beta-mercaptoethanol was not included in the sample buffer. Prior to loading onto the gel, the samples are heated in a boiling water bath for 5 min. The discontinuous gel system usually has 5% (acrylamide concentration) in the stacking and 10% in the resolving gel. Electrophoresis is carried out using Laemmli buffer at a constant current of 15 mA first, till the samples stack and then 30 mA till the completion. On completion of electrophoresis, gel is immersed in 0.1% Coomasie Blue R250 in methanol:acetic acid:water (4:1:5) with gentle shaking and is then destainded in destaining solution (20% methanol and 10% glacial acetic acid) till the background becomes clear.

PEGylated proteins can be additionally stained with iodine through a standard method developed by Kurfürst (Kurfürst M M., 1992) that specifically stains the PEG molecules. For iodine staining of purified PEG variants, briefly after electrophoresis the gel was soaked in a 5% glutaraldehyde (Merck) solution for 15 min at room temperature for fixation. Afterward the gel was stained for PEG as follows. First, the gel was put in 20 ml of perchloric acid (0.1M) for 15 min, and then 5 ml of a 5% barium chloride solution and 2 ml of a 0.1 M iodine solution (Merck, Titrisol 9910) were added. The stained PEGylated protein bands appeared within a few minutes. For dual staining of SDS PAGE the iodine stained gels were further stained by Coomasie Blue R250 using the protocol of Laemmli as described in [0044].

Kinetic assays (Shi et. al., 1994, Wu et. al., 1987, Wohl et. al., 1980) were used for determining the HPG activation by PEG modified or unmodified SK or its covalent variants especially when kinetic constants were needed to be determined. Varying concentrations of either PEG modified or unmodified SK or its covalently modified forms (10 nM-200 nM) were added to a final volume of 100 microliter in multi-well plate containing 1-2 uM of HPG in assay buffer (50 mM Tris-Cl buffer, pH 7.5, containing 0.5-1 mM chromogenic substrate and 0.1 M NaCl). The chromogenic substrate used (S-2251, Roche Diagnostics GmbH, Germany) was plasmin specific and gives yellow color product upon cleavage that can be monitored at 405 nm. The protein aliquots were added after addition of all other components into the well and taking the first spectrophotometric absorbance zero. The change in absorbance at 405 nm was then measured as a function of time in a Versa-Max tunable microplate reader from Molecular Devices USA. Appropriate dilutions of *S. equisimilis* streptokinase obtained from WHO, Hertfordshire, U.K. is used as a reference standard for calibration of international units in the unknown preparation.

Assay for determining the steady-state kinetic constants for HPG activator activity of PEG modified or unmodified SK and its covalently modified forms.

To determine the kinetic parameters for HPG activation, fixed amounts of PEG modified or unmodified SK or its covalently modified forms (0.05-0.1 nanomolar) were added to the assay buffer containing various concentrations of HPG (ranging from 0.035 to 2.0 micromolar) in the multi-well plate as described above. The change in absorbance was then measured spectrophotometrically at 405 nm for a period of 10-40 min at 25 C. The kinetic parameters for HPG activation were then calculated from inverse, Michaelis-Menton, plots by standard methods (Wohl et. al., 1980).

Various PEGylated SK or its muteins and the native SK was radio-iodinated with Iodine125 (I125) procured from PerkinElmer Singapore Pte Ltd. Using the Todogen (1,3,4,6-Tetrachloro-3α-6α-diphenylglucoluril) method (Fraker & Speck, 1978). According to the method used by Fraker and Speck, the Todogen is dissolved in chloroform and coated onto the wall of a borosilicate glass tube by evaporating the solvent with spray of nitrogen gas. For iodination, protein solution in Phosphate Buffered Saline (PBS) is added to the Todogen coated tube and mixed with I125. After approximately 10-30 min, the radio-iodinated protein is separated from free radio-iodine by desalting on a Sephadex G 25 fine matrix containing column (Amersham Biosciences).

Genetic Constructs

Construction of Streptokinases

The design and construction of the pET vector containing the SK gene (pET-23d-SK) has been described in Nihalani et al., (1998). It involved the cloning of the SK gene from *Streptococcus equisimilis* H46A in pBR 322 (Pratap et al., 1996), followed by subcloning into pET-23d, an expression vector containing a highly efficient ribosome binding site from the phage T7 major capsid protein (Studier and Moffatt, 1986) and further modification of the 5' end of the gene to minimize the propensity for formation of secondary structure. It had an in-frame juxtaposition of an initiation codon for Met at the beginning of the open reading frame encoding SK so as to express the protein as Met-SK. For details reference can be made to Sahni et. al; 2007 (U.S. Pat. No. 7,163,817).

SK muteins were also designed using the refurbished template as in case of SK so to get high intra-cellular expression capability. The circular map of pET-23d-SK has been depicted in FIG. 2. The scheme to make truncated derivatives of SK is otherwise explained in detail by Nihalani et al.,1998. Apart from gene sequencing, the authenticity of SK and its truncated derivatives were also established by gas phase N-terminal amino acid sequencing of proteins on an Applied Biosystems-Perkin Elmer protein sequencer model 476A or 491 clc.

Construction of covalently modified forms of SK by making a hybrid DNA polynucleotide between SK-encoding DNA and fibrin binding domains of human fibronectin and its cloning and expression in *E. coli* are explained in detail in U.S. Pat. No. 7,163,817. Briefly the fibrin binding domains are fused to streptokinase at N-terminus or at C-terminus or both at N and C-terminus to generate various covalently modified forms of streptokinase.

Example 1

Selection of Residues or the Regions of Protein for Generating Cysteine Variants of Streptokinase Residue selection for substitution or deletion is crucial to maintain the functionality of modified polypeptides. Therefore, cysteine mutagenesis plan requires both structural information present in crystal structure and the functional insights obtained through solution studies. Extensive structure and function studies over the years has gathered tomes of information about the role of different regions of streptokinase in plasminogen activation. To decide upon the residues or the region where the naturally present amino-acid can be preferably substituted with the cysteine, we utilized information present in three dimensional structure of SK or its isolated domain along with their functional relevance. The selection of residues for cysteine mutagenesis was partly based on the determination of the surface accessibility of the residues. Site of cysteine insertion was also limited to flexible regions of the streptokinase. To determine the surface exposure DSSP program was used. The DSSP code is frequently used to describe the protein secondary structures with a single letter code. DSSP is an acronym for "Dictionary of Protein Secondary Structure", The DSSP (Kabsch and Sander, 1983) program defines secondary structure, geometrical features and solvent exposure of proteins, given atomic coordinates in Protein Data Bank format. DSSP states each residue's exposure in terms of square Ångstroms. Run of the DSSP program on a given PDB file produce abbreviated DSSP format output. One can get the value of surface accessibility under the heading Acc in the DSSP format output. To determine the surface exposure, solved crystal structure of streptokinase (Wang et.

al. 1998, PDB ID 1BML) in complex of microplasmin was used. For the regions that were missing in this structure (175-181 and 252-262) crystal structure of the isolated beta domain (Wang et. al., 1999, PDB ID 1c4p) was used for determination of surface exposure. Some of the loops missing in the crystal structure were grafted in the experimentally obtained structure and there most preferred conformation was determined through molecular modeling tools. Residues not necessarily detected in the structure but are defined as highly accessible as they reside in the flexible region were also chosen for cysteine mutagenesis. Table 1 shows the surface accessibility values for different cysteine variants of SK (SEQ ID NO: 1) that were substituted with cysteine. The list however, does not limit the scope of cysteine substitution for the other naturally present amino-acids of SK. The accessibility values calculated by the program DSSP were directly taken as the measure of surface exposure. The DSSP program listed many surface exposed residues. But a careful selection was done while deciding the residues for cysteine substitution. This exercise included mutations evenly spread all along the three different domains i.e. alpha, beta and gamma of streptokinase. Mutations were also selected that fall in the secondary structural regions. Selection also included cysteine replacement of few residues that show exceptionally low surface accessibility just to ensure the fact that in principal each and every residue of the streptokinase can be replaced with cysteine and successfully modified with the thiol reactive reagents.

Despite of nucleotide and polypeptide sequence diversity, there exists a strong structural similarity among different bacterial plasminogen activators. The one-domain staphylokinase bears structural homology with the alpha domain of streptokinase. Also the two-domain bovine plasminogen activator obtained from *Streptococcus uberis* shows structural similarity with alpha and beta domains of streptokinase. Evolutionary conservation of protein three dimensional structure among different bacterial plasminogen activators makes it feasible to plan cysteine modifications of other streptokinase variants that are isolated from different bacterial species.

Example 2

Genetic Construction of Cysteine Variants of Streptokinases

All the genetic constructs to express streptokinases were generally constructed by using conventional approaches known in the art. The methods of DNA manipulation to incorporate mutations are described, for example, in 'PCR Protocols: A Guide to Methods and Applications', edited by Innis, M. A. et al. 1990., Academic Press Inc., San Diego, Calif. and 'PCR Protocols: Current Methods and Applications' edited by B. A. White, 1993., Humana Press, Inc., Totowa, N.J., USA. Bacterial and Yeast expression cassettes were made by inserting the DNA molecule encoding the desired streptokinases into a suitable vector (or inserting the parent template DNA into the vector and mutagenizing the sequence as desired therein), then transforming the host cells with the expression cassette using conventional methods known in the art. Specific mutations were introduced into the desired constructs using a variety of procedures such as PCR mutagenesis techniques (Innis et. al., 1990), mutagenesis kits such as those sold by Stratagene ("Quick-Change Mutagenesis" kit, San Diego, Calif.) or Promega (Gene Editor Kit, Madison Wis.). In general, oligonucleotides were designed to incorporate nucleotide changes to the coding sequence of Streptokinases that result in substitution, deletion or addition of desired residue for the naturally present residue. Mutagenic primers were also designed to add the cysteine at the beginning of the mature protein, i.e. proximal to the N-terminal amino-acid or following the last amino acid in the mature protein, i.e. after the C-terminal amino-acid of the Streptokinase and its truncated constructs. Similar strategy was used for insertion of cysteine residues between any two selected amino-acids of the Streptokinase or any of its form represented by SEQ IDs present in Table 2. Using the standard methods, corresponding cysteine containing mutants were generated on various forms of SK. The transformed clones for different mutants were then screened and confirmed by automated DNA sequencing using fluorescent dyes on an Applied Biosystems 3130x1 genetic analyzer 16 capillary DNA sequencer.

Table two lists different polypeptide constructs expressing one of the followings: streptokinase; its muteins; species variants; or covalently modified forms. The native full length polypeptide sequence of streptokinase has been assigned SEQ ID NO: 1. The truncated form of SK where C-terminal 31 residues are deleted is depicted by SEQ ID NO: 2. The truncated form of SK where N-terminal 15 residues are deleted is represented by SEQ ID NO: 3. Polypeptide that contains deletion of both N-terminal 15 residues and C-terminal 31 residues of SK is given SEQ ID NO: 4. Functional fragment of SK where the N-terminal 49 residues are deleted has been assigned SEQ ID NO: 5. Streptokinase construct in which both N-terminal 59 and C-terminal 31 residues are deleted has been given SEQ ID NO: 6. Full length polypeptide of SK (residues 1-414) that contains alanine substitution for Asparagine 90 in the alpha domain is represented by SEQ ID NO: 7. Beta domain mutant polypeptide of full length SK that has substitution of Tyrosine in place of Alanine has been given SEQ ID NO: 8. Similarly SEQ ID NO: 9 represents beta domain mutant of SK where Aspartate residue at 238th position is substituted with Alanine. SEQ ID NO: 10 is assigned to beta domain mutant of streptokinase where Glutamate at 240th position is substituted with Alanine. SEQ ID NO: 11 and SEQ ID NO: 12 represent Arginine to Alanine, and Lysine to Alanine mutation at 244th and 246th residues respectively, in full length SK. The 250 loop mutant of beta domain of SK where Leucine residue at 260th position is substituted with Alanine is given SEQ ID NO: 13. The gamma domain mutant of SK where Aspartate residue at 359th position is substituted with Arginine is represented by SEQ ID NO: 14. The double mutant of SK where both Histidine 92 and Serine 93 are substituted with Alanine is represented by SEQ ID NO: 15. Another double mutant of SK, where two consecutive Lysine residues at 278th and 279th position were substituted by Alanine is represented by SEQ ID NO: 16. The mutants of SK where Asparagine at 90th position in alpha domain, Aspartate at 227th position in beta domain or Aspartate at 359th position of gamma domain have been deleted are given SEQ ID NO: 17, SEQ ID NO: 18 and SEQ ID NO: 19 respectively. Matured and active forms of SK are available from a number of species and subspecies variants of the genus *Streptococcus*. To validate the feasibility of cysteine mutagenesis and subsequent PEGylation across the different forms of SK, we also selected variants of SK derived from *Streptococcus* species, namely *pyogenes* and *dysgalactiae*. The SK species variant derived from *Streptococcus pyogenes* is given SEQ ID NO: 20 and the one obtained from *Streptococcus dysgalactiae* is given SEQ ID NO: 21. The covalently modified form of SK where fibrin binding domains are present at the N-terminus of SK is given SEQ ID NO: 22. The C-terminus fibrin binding domain fusion product of SK has been assigned SEQ ID NO 23. Hybrid polypeptide that contain fibrin binding domain both at N and C-terminus of SK is given SEQ ID NO: 24. Genetic constructions of fibrin domain fused forms of SK are detailed out in U.S. Pat. No. 7,163,817. Different polypeptides that include native full length SK, its muteins, species variants and the covalently modified forms were further used for generation of cysteine variants.

Cysteine variants generated on different forms of SK mentioned in TABLE 2 have been assigned unique SEQ IDs. Table 3 to 28 lists individual variants along with their unique SEQ IDs.

Table 3: variants those were designed on native full length SK (SEQ ID NO: 1)

Table 4: variants those were designed on truncated SK 1-383 (SEQ ID NO: 2)

Table 5: variants those were designed on truncated SK 16-414 (SEQ ID NO: 3)

Table 6: variants those were designed on truncated SK 16-383 (SEQ ID NO: 4)

Table: 7: variants those were designed on truncated SK 50-414 (SEQ ID NO: 5)

Table 8: variants those were designed on truncated SK 60-383 (SEQ ID NO: 6)

Table 9: variants those were designed on mutant SK polypeptide (SEQ ID NO: 7)

Table 10: variants those were designed on mutant SK polypeptide (SEQ ID NO: 8)

Table 11: variants those were designed on mutant SK polypeptide (SEQ ID NO: 9)

Table 12: variants those were designed on mutant SK polypeptide (SEQ ID NO: 10)

Table 13: variants those were designed on mutant SK polypeptide (SEQ ID NO: 11)

Table 14: variants those were designed on mutant SK polypeptide (SEQ ID NO: 12)

Table 15: variants those were designed on mutant SK polypeptide (SEQ ID NO: 13)

Table 16: variants those were designed on mutant SK polypeptide (SEQ ID NO: 14)

Table 17: variants those were designed on mutant SK polypeptide (SEQ ID NO: 15)

Table 18: variants those were designed on mutant SK polypeptide (SEQ ID NO: 16)

Table 19: variants those were designed on mutant SK polypeptide (SEQ ID NO: 17)

Table 20: variants those were designed on mutant SK polypeptide (SEQ ID NO: 18)

Table 21: variants those were designed on mutant SK polypeptide (SEQ ID NO: 19)

Table 22: Cysteine variants of *Streptococcus pyogenes* MGAS10270 (SEQ ID NO: 20)

Table 23: Cysteine variants of *Streptococcus dysgalactiae* subsp. *equisimilis* (SEQ ID NO: 21)

Table: 24: Cysteine variants of SK with N-terminal fused fibrin binding domain (SEQ ID NO: 22)

Table 25: Cysteine variants of SK with C-terminal fused fibrin binding domain (SEQ ID NO: 23)

Table 26: Cysteine variants of SK with both N and C-terminal fused fibrin binding domains (SEQ ID NO: 24)

Table 27: Cysteine insertion mutants of SK

Table 28: variants of SK where cysteine is placed at the N or C-termini with or without a peptide extension.

These examples demonstrate that one can generate cysteine variants on virtually all forms of SK such as native full length, truncated, N or C terminally extended or in fusion with other polypeptide sequence. We also generated cysteine variants of substitution, insertion or deletion mutants of SK. This validates the applicability of this invention to any form of SK for cysteine mutagenesis and subsequent modification with thiol reactive agents.

The constructs obtained from Example 2 were utilized in all further experiments conducted to arrive at the present invention. However, it should be understood that the list of cysteine variants of streptokinases are merely exemplary and not exclusive. The design and synthesis of alternative and additional cysteine variants of streptokinases in accordance with this invention are well within the present skill in the art. Synthesis of such variants may be conveniently effected using conventional techniques and methods.

Example 3

Over-Expression and Purification of Biologically Active Streptokinases

The native streptokinase protein (nSK), its mutants and their subsequent Cysteinyl mutants to be purified were each grown from single colony, streaked on LB-Amp plate from their BL21 (DE3) glycerol stocks. The primary cultures were developed by inoculating pET-23d-SK or SK variants into 10 ml of LB medium containing 100 microgram/mL ampicillin (LB-Amp medium) and incubated for 8-16 hours at 30-37 C, under shaking conditions (180-280 rpm). This pre-inoculum was used to seed 500 ml of LB-Amp medium at 2-10% v/v and allowed to grow at 30-37 C., at 180-280 rpm to an O.D600 nm (optical density measured at 600 nano-meter) of 0.5-1.0. At this stage, it was induced with IPTG (final concentration of 0.5-1.0 millimol) (Chaudhary et al., 1999; Dhar et al., 2002) and further grown at 40 C, for 6-12 hours under shaking condition. Cells were then harvested by centrifugation at 6000-7000 g for 10 min. The pellet was then washed twice with ice-cold buffer (final concentrations-100-150 mM NaCl, 10-50 mM Tris-Cl, pH 8.0, and 1-5 mM EDTA) and subjected to sonication (Heat System, New York) at 4 C, under conditions of 30 sec sonic-pulses interspersed with equal periods of rest. The cell lysate was then centrifuged at high rpm (10000-14000 g) for 15 min. The SDS-PAGE analysis show that more than 90% desired protein had gone to the Inclusion Bodies (IBs). The IBs were then solubilised in 8 Molar urea at room temperature for 45 min under constant gentle shaking condition. The protein in supernatant was folded after 10-fold dilution (Sundram et al., 2003) in the loading buffer (0.4 M NaCl in 20 mM PB). The sample was then chromatographed on Phenyl Agarose 6XL beads and eluted in water. The protein so obtained was then subjected to further purification by anion-exchange chromatography on a DEAE-Sepharose column (GE-Amersham Biosciences). Protein fractions after HIC were pooled and Tris. Cl pH 7.5 was added to a final concentration of 20 mM Tris. Cl, after which it was loaded onto a column packed with DEAE-Sepharose (Fast Flow) pre-equilibrated with 20 mM Tris. Cl (pH 7.5). After washes with buffer containing 20 mM Tris. Cl (pH 7.5), the bound protein was eluted using a linear gradient of salt (0-0.5 M NaCl) in 20-25 mM Tris. Cl. SK proteins eluted were generally more than 95% pure, as analyzed by SDS-PAGE. The amount of protein in each fraction was measured using Bradford's method of protein estimation (Bradford., 1976) and confirmed by Absorption at 280 nm. All chromatographic steps were conducted at 4° C. The fractions containing protein were analyzed on SDS-PAGE along with standard SK and Molecular mass markers. Desired fractions were pooled conservatively to obtain the homogenous preparation of SK or SK mutants.

Over expression and purification of various covalently modified constructs formed by SK and Fibrin Binding Domains (FBDs) in *E. coli* and their in vitro refolding are described in U.S. Pat. No. 7,163,817 wherein the expressed proteins were subjected to in vitro refolding and purified by column chromatography. Briefly, the solubilized inclusion bodies were diluted to a final protein concentration of 1 mg/ml using distilled water; together with the addition of the following additional components (final concentrations in the diluted mix are given): Tris-Cl, pH 8.0, 50 mM; NaCl 100-150 mM; EDTA 1-5 mM; mixture of reduced and oxidized glutathione 1.25 mM:0.5 mM. The refolded population was separated and purified on a column packed with fibrin-sepharose beads. For detailed description of the refolding, purification and characterization of the refolded protein please refer to Sahni et. al; 2007 (U.S. Pat. No. 7,163,817).

Example 4

Covalent Conjugation of Cysteine Variants of Streptokinases with Polyethylene Glycol The thiol groups of the cysteine variants of streptokinases were selectively PEGylated using maleimide-activated linear methoxy PEG of different sizes such as 5 KDa, 20 KDa and 40 KDa (JenKem Technology, USA). For the PEGylation reaction the polypeptide to be PEGylated was kept in 50-100 mM Tris-Cl buffer pH 8.0 containing 100-150 mM of NaCl. To this, 5 molar excess of PEG reagent was added. The molar excess was calculated while taking into consideration the number of free thiols to be reacted with PEG reagent and not merely the protein's molarity. The reaction mix was allowed to stir at room temperature for 1.5-4 hours, and then the reaction was stopped by adding 1 mM of DTT. PEGylated protein from the free PEG and the unreacted SK was purified by anion exchange chromatography on a DEAE sepharose column (GE-Amersham Biosciences). The reaction mixture was diluted 10-15 fold with 25 mM Sodium Phosphate buffer of pH 7.4 after which it was loaded onto a column packed with DEAE-Sepharose (Fast Flow) pre-equilibrated with the same buffer. After washes with buffer containing 25 mM Sodium Phosphate, the bound protein was eluted using a linear gradient of salt (0-0.5 M NaCl) in 25 mM Sodium Phosphate. Alternatively, if some of the PEGylated derivatives failed to separate from unreacted PEG cleanly by ion-exchange, these reactions were subjected to size-exclusion chromatography on Sephadex 75 (Amersham Biosciences) using a buffer of neutral pH and final NaCl concentration of 100-150 mM. Also, in some cases, where purified cysteinylated protein samples that showed disulfide bonded dimers were first reduced by addition of 10 mM DTT. The DTT treated samples were desalted on a column packed with Sephadex G-25 (fine) beads, and immediately used for PEG conjugation. The homodimeric forms of SK due to intermolecular disulfide linkage can also be separated using size-exclusion chromatography on Sephadex 75 and may be useful over monomeric streptokinase for therapeutic uses due to its large size and slow clearance.

Figure 1:
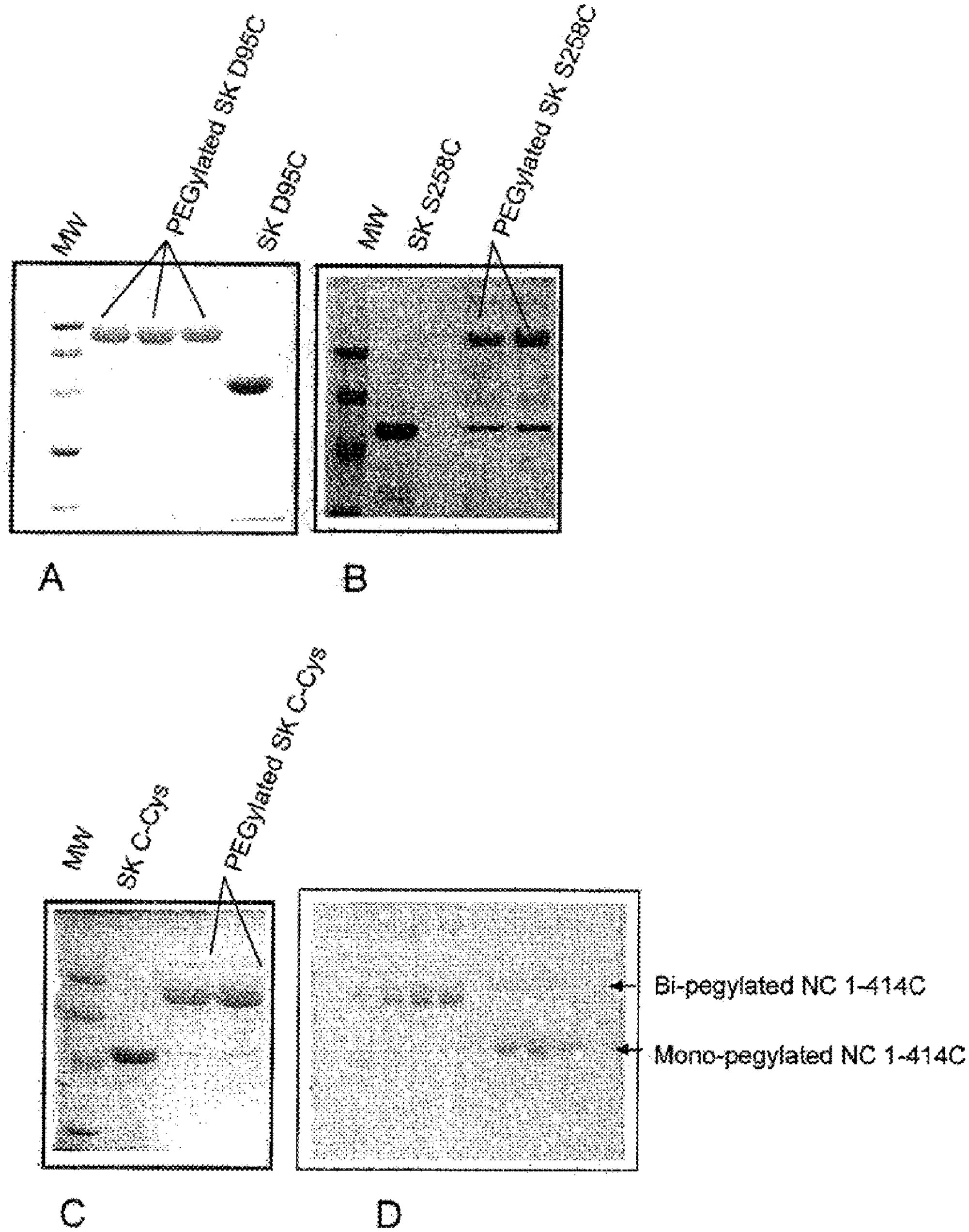
FIG. 1 depicts an SDS-PAGE showing purified cysteine variants of streptokinase and their PEG adducts. Panel A shows cysteine variant of alpha domain (SEQ ID NO: 30) of streptokinase where aspartate present at 95th position in the flexible loop 88-97 has been replaced with cysteine. This unique cysteine so generated has been PEGylated with thiol reactive PEG polymer methoxy-PEG maleimide of 20 KDa followed by purification to give a homogeneous protein-PEG adduct. Panel B shows cysteine variant of the SK beta domain (SEQ ID NO: 49) where serine at 258th position in the 250 loop of beta domain has been replaced with cysteine. This unique cysteine so generated has been PEGylated with thiol reactive PEG polymer methoxy-PEG maleimide to give protein-PEG adduct of higher molecular weight. Panel C shows cysteine variant of streptokinase where the original sequence of streptokinase has been extended by one more amino-acid by adding cysteine at C-terminus position (SEQ ID NO 490).

PEG cross-linking in all cases was confirmed by SDS PAGE. Gel electrophoresis showed >95% of the PEGylated protein in the fractions that were obtained after removal of the unreacted protein and the free PEG reagent. FIG. 1 shows few mono and bi-PEGylated variants of SK. Panel A shows one of the representative (D95C, SEQ ID NO: 30) PEGylated cysteine variant of the alpha domain of streptokinase where naturally present aspartate residue has been replaced with cysteine and conjugated with methoxy PEG maleimide of molecular mass 20 KDa. Panel B depicts one of the representative (S258C, SEQ ID NO: 49) PEGylated cysteine variant of the beta domain of streptokinase where naturally present serine residue in the 250 loop of beta domain has been replaced with cysteine and conjugated with methoxy PEG maleimide of molecular mass 20 KDa. Panel C shows one of the representative (C-Cys, SEQ ID NO: 490) PEGylated cysteine variant of the gamma domain of streptokinase where one cysteine has been placed at the C-terminus of the SK and conjugated with methoxy PEG maleimide of molecular mass 20 KDa. Panel D shows one of the bi-PEGylated cysteine variant of SK (SEQ ID NO: 493) where one cysteine is placed each at the N-terminus and C-terminus of the molecule and conjugated with methoxy PEG maleimide of molecular mass 20 KDa. Conjugation of PEG at the two extremes of SK was carried out with the premise that two bulky PEG groups will enclose the protein in a flexible cocoon and extend its in vivo survival for prolong period. At the same time extensive masking of the immuno-dominant regions may attract a negligible immuno-reactivity of the injected molecule in a subject. Fractions containing PEGylated protein were pooled and formulated for activity assays, and in some instances were further characterized by MALDI-TOF mass spectrometry. The mass spectrometry also confirmed the expected molecular mass of PEG adduct of streptokinase and its covalently modified forms.

Example 5

Casein-Plasminogen Overlay for Rapid Detection of Plasminogen Activation Ability Activity of different cysteine variants of SK and SK chimeras were detected by overlay of casein and HPG in soft agar. The original method of Malke and Ferretti, 1984 was modified where purified SK (0.1-0.5 microgram) was directly spotted on marked depressions on LB-Amp agar plates. The plate was then incubated at 37° C. for 10 minutes; thereafter, casein-HPG-agarose was overlaid by gently pouring the mixture of solutions A and B on top of the plate containing the spots. Solution A was prepared by heating 1 g of skim milk in 15 ml of 50 mM Tris, Cl (pH 7.5), after which it was maintained at 37° C. in a water-bath till further use. Solution B was prepared by heating 0.38 g of agarose in 15 ml of 50 mM Tris. Cl (pH 7.5) at 50° C. After tempering the solution to 37° C., 3 μl of TritonX-100 (0.04% v/v) and 100-200 μg HPG was added and gently mixed without frothing. The plate was then incubated at 37° C. for 1-4 hrs and observed for the generation of zones of clearance (halo formation) due to casein hydrolysis, following HPG activation. The area of the lysis zone (halo) surrounding the well into the agarose medium was taken into consideration for comparing the plasminogen activation ability for the streptokinase and its covalently modified variants. All cysteine variants of streptokinases retained substantial plasminogen activation ability as examined by Casein-HPG overlay assay. Cysteine variants of streptokinases were further taken for PEG conjugation with thiol reactive PEG of different molecular weights ranging from 5000 Dalton to 40,000 Dalton and their activity was determined using Casein-HPG overlay assay with activity of PEG conjugated with the justification that a loss in plasminogen activity ability All PEG modified variants of streptokinases showed substantial plasminogen activation ability under caseinolytic assay and are therapeutically useful. However, a desired combination of suitable half-life that is clinically required along with reduced immune reactivity, make some derivatives more useful over others.

Comparatively reduced activity in some cases may well be compensated by increased proteolytic stability and in vivo half-life of the PEG-protein adducts.

Alternatively, the plasminogen activation ability were also measured as explained previously. Table 29 shows the HPG activator activity and the kinetic constants for a few representative PEGylated SK variants. Table 30 summarizes the range of activity for the different PEGylated variants of covalently modified streptokinases that contain fibrin domain fusion.

The activity measurement for truncated form of SK (50-414 and 60-383) and their PEGylated variants required supplementation of synthetic peptides 1-49 for optimal amidolytic and plasminogen activation capabilities. It has been documented in the literature that truncated variants of SK that are devoid of N-terminal peptide corresponding to 1-59 region are poor plasminogen activators and show increased activity upon supplementation of either SK 1-59 peptide or fibrin in the reaction mixture for optimal amidolytic and plasminogen activation capabilities (Nihalani et. al., 1998 and Sazonova et. al., 2004). PEGylated derivatives of SK that does not contain 1-49 or shorter N-terminal peptides show fibrin dependence for plasminogen activation hence; their actions are restricted to clot mainly making them clot-specific.

Example 6

Proteolytic Stability of PEGylated Cysteine Variants of Streptokinases

For proteolytic stability, 50 microgram of each PEGylated derivative and the native SK, as control, was incubated with 50 microliters of 50 mM Tris-Cl and 100 mM NaCl. To this, trypsin was added to give a final ratio of PEGylated Protein: Trypsin of 1000:1 (w/w). The reaction was kept under shaking condition at 25° C. for two to four hours. Equal aliquots of trypsinized protein was spotted on the LB-Amp agar plates and the residual activity was measured in a similar way as explained in EXAMPLE 5 for detection of SK activity. Equal aliquots were also spotted from the control reactions where only trypsin was added in the reaction or only SK or SK hybrids were added in the reaction. In this case also the zone of lysis on agarose overlay was measured for each of the trypsinized PEGylated streptokinase or its covalently modified variants. The area of zone of lysis becomes a direct measure of the residual plasminogen activation ability for the protected streptokinase or its variants. This assay showed significant protection for the different SK variants under this study when they were conjugated with single, double or triple PEG moieties and incubated with trypsin or plasmin. We found a multiplied increase in proteolytic stability with attachment of more than one PEG group to the SK variants.

Alternatively, the residual activity measurements were also confirmed for trypsinized PEGylated streptokinase or its covalently modified variants by testing their Plasminogen activation capability using the one-stage assay described earlier using chromogenic substrate spectrophotometrically [0046]. The trypsinized SK and PEGylated SK variants at varying concentrations (1-10 nM) were added to a final volume of 100 microliters in a multi-well plate containing 1-2 uM of HPG in assay buffer (50 mM Tris-Cl buffer, pH 7.5, containing 0.5-1 mM chromogenic substrate and 0.1 M NaCl). The protein aliquots were added after addition of all other components into the well. The change in absorbance at 405 nm was then measured as a function of time in a VersaMax model tunable microplate reader from Molecular Devices Inc., USA. Results obtained through this method were in consonance with those obtained through caseinolytic assay. It was found that significant functional activity retained in all the PEGylated forms of streptokinase and its covalently modified form when incubated with trypsin. The unpegylated streptokinases when subjected to similar conditions show barely detectable activity and are prone to trypsin digestion.

Samples subjected to trypsinization were also examined on reducing SDS-PAGE to physically observe the proteolytic stability, and the generation of truncated fragments as a result of the proteolysis. This gave a qualitative assessment of protected protein subjected to trypsinization. For this, aliquots were taken at different time-intervals from the reaction mixture and inhibited by the addition of 20 molar excess of Soybean Trypsin Inhibitor (GE-Amersham Biosciences) to stop any further tryptic activity. Samples collected at different time points (5-180 min) were electrophoresed on 10% SDS-PAGE and analyzed for the protected intact protein. Results obtained from this exercise also substantiated our functional examination of the trypsinized proteins. More residual plasminogen activation ability under assay conditions also reflected in more protection of the protein when examined for physical intactness on the SDS-PAGE.

Example 7

N and C-Terminally Extended SK Variants and their PEG Modified Forms

In order to establish that an arbitrary extension of few amino-acids both at N or C-terminus of streptokinase or its variants will invariably produce the same result as that obtained with their unextended counterpart, the SK or its cysteine variants were modified either at N-terminus or C-terminus with small amino-acid extensions.

N-terminal extended forms were made using two different strategies giving a polypeptide of two different lengths viz. one with 6 amino-acid extension and another other with a 20 amino-acid extension. Using the overlap extension strategy 18 nucleotide extension coding for 6 histidine residues were placed before the N-terminal amino-acid of the mature streptokinase. The product of this modification was a N-terminally extended protein with additional six amino-acids. To incorporate the 20 amino-acid extensions the cassettes encoding the SK or its variants were transformed from pET 23d to pET 15b (Cat. No. 69661-3, Novagen, Inc. US). Placing the cassette into the pET 15 b gave an N-terminal extension of 20 amino-acids that include a stretch of six histidine residues and a thrombin cleavage site. The cleavage of N-terminal extension from the polypeptide can be effected with thrombin. This removes the stretch of Histidine tag and yields a processed polypeptide with amino-acid sequence of SK only. SEQ ID NO 496 shows the amino-acid sequence of SK that was obtained due to the cloning in pET 15b.

To generate the C-terminal extended product, a stretch of six histidine residues was added just after the last amino-acid of SK or its variants using the overlap extension strategy. This resulted in placement of additional six residues at the C-terminus. The proteins were purified either using the metal affinity chromatography or the purification methods explained in Example 2 to obtain a homogeneously purified product. Subsequently these purified N or C-terminally extended products of SK or its variants were modified with PEG using the chemistry explained in Example 4. Biochemical characterization for functional activity and the proteolytic stability yielded similar result as those obtained with their unextended counterparts. This gave a strong evidence for the conclusion that other N or C-terminus extended products of SK or its variants would yield similar results. A skilled artisan can think of innumerous possibilities of extending both N and C-terminus of SK or its variants to yield functional forms of streptokinase that can be used for cysteine substitution, insertion or addition and their subsequent thiol modifications with PEG or other sulfhydryl reactive agents.

Example 8

Assigning New Functional Attributes to the SK Variants where PEG Groups are Attached at the Two Termini i.e. N and C-Terminus of SK or its Truncated Variants It was observed that addition of PEG groups simultaneously at both N and C termini of streptokinase and any of its truncated functional variants under study makes its activity dependent on presence of plasmin. This new functional attribute was assigned when we observed that bi-PEGylated SK variant shows a lag (see FIG. 3) of several minutes in the plasminogen activation profile. To our surprise, when the bi-PEGylated SK variant was examined for plasminogen activation after it is complexed with plasmin, it showed normal (i.e. native SK like) kinetics of plasminogen activation (see FIG. 4). The inability to be self-activated immediately (as is the case with native, unmodified SK which activates PG virtually upon contact) is due to a plasmin-dependent mode of its action. In contrast, native SK does not require any plasmin to be activated, but is activated virtually as soon as it complexes with PG. In experiments where samples were withdrawn from reactions at different time points in the progress curves of plasminogen activation i.e. during the early phase (in the lag period), rapid activation phase etc, and analyzed with SDS-PAGE to follow the type of products, it was observed that the activation closely followed the generation of truncated fragments in which the PEG containing peptide segments at the ends of the polypeptide were cleaved off by the action of plasmin. Similar results were obtained by Mass spectroscopic analyses. These results clearly established a correlation between plasminogen activation by the PEG-modified SK upon the elimination of the PEG groups, indicating a plasmin-mediated mechanism of activation wherein the bulky PEG groups, once removed, allowed the SK fragments to interact with plasminogen just as nSK and activate it rapidly. Clearly, therefore, the presence of the PEG groups at the termini—apart from conferring a stabilizing influence against proteolysis, immune reactivity etc expected irrespective of position—also resulted in the unexpected creation of a plasmin dependent "switch", which has powerful beneficial effects in thrombolytic therapy.

The functional attribute of plasmin dependency i.e. in-built "plasmin switch" was found among other bi-PEGylated cysteine variants of truncated SK, where additional cysteines are placed at the two extremities of the polypeptide i.e. at the N- and C-termini, which exhibits an unexpected property in respect to its human plasminogen activation characteristics in that it has a markedly slower initial rate of activation of plasminogen (PG) compared to unmodified SK, but becomes fully capable of activating plasminogen in a manner similar to that of unmodified SK after an initial lag of several minutes' duration when assayed for PG activation in vitro. Table 4 shows the steady-state kinetics parameters for HPG activation by SK and the two different bi-pegylated SK variants. NC 1-414 denotes SK variant where cysteine has been added both prior to naturally present N-terminal amino-acid and after the C-terminal amino-acid to generate a double cysteine mutant of SK. NC 1-383 denotes the truncated variant of SK where one cysteine each has been added prior to the naturally occurring N-terminal amino-acid, and after the three consecutive glycine residues that are placed next to the 383rd amino-acid. The data shows that both the bi-pegylated variants show a pronounced initial lag before they become fully functional. The kinetic parameters, when calculated from the linear phases of the reaction progress curves after the abolishment of the lag phase, showed that once fully activated after completion of the initial lag, both bi-pegylated variant became significantly active in terms of their PG activation abilities when compared to SK. Similar results were obtained with two bi-pegylated SK variant where the PEG is attached at the termini, showing that this new functional attribute is positional in effect and not merely dependent on the presence of dual PEG modification within the same molecule. Thus, plasmin dependency is imparted into the molecule whenever either or both of the two termini at the N- and C-termini, in any functional fragment of SK are PEGylated.

In addition, it will be evident to a person skilled in the art that such a functional attribute can also be imparted to the molecule by any modification in and around the two termini (such as a suitable lysine side-chain) would also lead to a plasmin dependent lag in plasminogen activation characteristics owing to proteolytic processing of the streptokinase wherein such "blocking" groups which may be PEG moieties, other protein domains, intact proteins such as albumin etc are removed by proteolysis, allowing the remainder of the polypeptide to become functionally active vis-à-vis plasminogen activation. Similar effects are therefore to be expected when one attaches the PEG groups at the termini using whatsoever chemistry is available. One such chemistry utilizes the differential pKa value of the alpha amino group at the N-terminus to specifically conjugate amine reactive PEG groups at the alpha amine. Similar attributes with different truncated combinations of termini indicate that as long as the two PEG groups are placed at any location in or around the two termini, the plasmin dependency can be generated in the molecule.

Thus, after injection into the body, such a SK variant will make its voyage through the vascular system while still in an inactive, or partially active, state. However, it will preferentially become activated in the immediate vicinity of the clot the moment it contacts the clot, which is known to be plasmin-rich whereas the general circulation is not (free plasmin being rapidly inactivated in the 'open' circulation due to the presence of plasmin-specific Serpins (serine protease inhibitors) such as alpha-2-antiplasmin and alpha-2-macroglobulin), thereby obviating or significantly minimizing the systemic PG activation coincident with natural SK administration which immediately activates PG upon administration and consequent side-effects such as hemorrhage and large scale destruction of various protein components of the vascular system. This property i.e. plasmin-dependant activation, along with the extended elimination half-life, and low immunogenic and antigenic reactivity would result in not only an overall diminished generation of free plasmin in the general circulation but also the ability for the thrombolytic to be administered repeatedly for various circulatory maladies in a relatively lower dose while avoiding unwanted immune reactions. The net result shall be a continued and more efficient fibrinolysis at the target sustained by considerably lowered therapeutically effective dosages of the thrombolytic agent with minimized side-effects.

A further improvement over this attribute is to impart the fibrin dependency in the bi-PEGylated molecule by placing the PEG groups at the two extremes of SK 50-414 or SK 60-383 variants. This outcome is possible because deletion of a "catalytic switch" (SK residues 1-59) alters the conformation of the SK alpha domain and converts such truncated fragments into a fibrin-dependent plasminogen activator as reported by Reed et. al., 1999 and Sazonova et. al., 2004. The expected outcome of designing such bi-PEGylated variants is both a plasmin dependency and an improved fibrin dependency/affinity. These two attributes i.e. plasmin dependency and the fibrin affinity/selectivity makes the molecule a PG activator that is highly directed towards fibrin clots. Such molecules can effectively obviate the problem of systemic PG activation and allow a stringent PG activation to occur only in the near vicinity of the fibrin clot.

Example 9

Pharmacokinetic Analysis of PEGylated Cysteine Variants of Streptokinases

All proteins used for injection in animal were treated thoroughly to remove endo-toxin by passage through a column consisting of Polymyxin B Agarose (BioRad Inc., Palo Alto, Calif., USA) gel. Various monoPEGylated SK derivatives representing cysteine incorporation in each domain, and the native SK (as control) were radio-iodinated with 125I using the Todogen (Fraker & Speck, 1978) method, and separated from free radio-iodine by passing through Sephadex G-25 desalting column. CD1 mice (23-25 g) were anaesthetized with 3% iso-fluorane and mild vasodilation was induced by exposing the tail to a 100 watt fluorescence lamp. Mice were then injected with around 7 microgram of radio-iodinated protein in sterile saline, via the tail vein, and whole blood samples of approximately 50 microL were collected over time using tail transaction or from retro-orbital sinus and kept in heparinized eppendorf tubes. Samples were processed to yield plasma and were evaluated for 125I activity in a Perkin-Elmer-scintillation counter. After determination of plasma 125I activity, an equal volume of 20% TCA was added to each plasma aliquot, to determine the amount of 125I activity that remained associated with intact protein. The samples were briefly vortex-mixed and were placed on ice for 15 min. The aliquots were centrifuged at approximately 3000×g for 10 min, and the supernatant, containing free label or label associated with fragmented protein, was aspirated from each sample. The resultant TCA-precipitated pellet was analyzed for 125I activity. In general, duplicate samples were processed and the values were averaged.

Residual acid-precipitable radioactivity in different plasma samples following injection for PEGylated cysteine variants of streptokinases were used for of in vivo half life determination. Results of half-life study show variable degrees of in vivo retention for the different PEG variants when they were conjugated with single or double or triple PEG moieties. The results show that with the addition of more than one PEG group the resultant half-lives are also amplified. The half-life for few selected PEGylated SK variants are summarized in Table 32, which shows that on an average there is 5 to 120 fold increase in the elimination half-life for the different mono, bi and tri-PEGylated cysteine variants of streptokinases. Plasma retention times of PEGylated cysteine variants of SK are found to be dependent on the position of PEG attachment. Alpha 88-97 loop PEG variants show maximum increase (~15-20 fold) in in vivo retention time while beta domain PEG variants of SK show intermediate increase (~10-12 fold) in the in vivo retention. Gamma domain PEG variants show nearly 4-5 fold increase in the in vivo half life. In general, all PEGylated streptokinases showed multifold increase in the half-life when compared to native SK (12-15 minutes). This signifies a considerable increase in the in vivo half-life of the PEGylated cysteine variant, and demonstrates the extended time-action of the PEGylated SK. Similar results were obtained with the other cysteinyl SK variants after PEGylation. It is well known that an extended time-action of the PEGylated variant is a result of the PEG moiety and is not dependent on the location of the PEG polymer on the SK. Thus, attaching the PEG moiety via a cysteine residue will result in a PEGylated SK or SK chimeric variant with extended time-action characteristics allowing for fewer administration of the PEGylated compound while maintaining a high blood level of the compound over a prolonged period of time.

Additivity in the elimination half-life when two PEG groups are attached shows that one can manipulate at will, or tailor-make, the elimination half-life by conjugation of PEG groups in required number, position and also by varying the PEG polymer size.

Example 10

Immune Reactivity of PEGylated Cysteine Variants of Streptokinases

Reactivity of nSK and PEGylated cysteine variants of SK and its covalently modified forms against SK (polyclonal) anti-sera raised in rabbit was examined by an ELISA-based method. The procedure for ELISA was as follows.

1. SK and PEGylated SK variants were first diluted in 0.2M Bicarbonate buffer, pH 9.2 to make 100 microliter of solution containing 0.75 microgram to 1.5 microgram of protein and this was added to each well of the microtiter plate (Nunc 96-Well Microplates, Cole-Parmer USA)

2. The antigen coated plate was covered with Paraffin and incubated in the cold room overnight in a moist box containing a wet paper towel or at room temperature and humidity for two hours under gentle shaking condition.

3. The plate was emptied and the unoccupied sites are blocked with 200 μl of blocking buffer containing 5-10% of skim-milk in Phosphate buffered saline (PBS) for 1 hr at room temperature.

4. The plate was emptied and washed four times with wash buffer made up of PBS.

5. The primary antibody solution was first diluted in PBS to give a dilution factor of 50000. 100 μl of the diluted antibody was added to each well. The plate was then incubated at room temperature for 45-60 minutes under gentle shaking.

6. The plate was emptied again and washed four times with wash buffer.

7. The Horse-redish peroxidase enzyme-labeled antibody against antigen was diluted appropriately in PBS. 100 μl of this dilution was added to each well and incubated at room temperature for 1 hr.

8. The plate was emptied again and washed six times with 1× PBS.

9. To each well 100 μl of 1× TMB (Tetramethylbenzidine Liquid substrate, Sigma-Aldrich, USA) was added and the plate was left for 10 minutes at room temperature.

To stop the reaction 50 μl 1N Sulphuric acid was added to each well and the color development was read spectrophotometrically at 450 nm.

Absorption values at 450 nm in the ELISA, obtained for unmodified nSK and various PEGylated variants of SK, were used for evaluation of the relative levels of their immune-reactivity against SK polyclonal sera raised in rabbit. The ELISA studies showed that conjugation of one PEG group of 20 KDa in any of the three domain of SK reduces its reactivity to well below 20% against SK polyclonal sera. Conjugation of two PEG groups of 20 KDa i.e. one at N- and another at C-terminus of SK reduced their reactivity to well below 10% against SK polyclonal sera. Conjugation of three PEG groups of 20 KDa i.e. one in each domain of SK rendered the reactivity to barely detectable levels. Hence, it is clear that the conjugation of the PEG moiet(ies) to the different regions of SK significantly reduces their reactivity against SK polyclonal sera. In vitro tests showing reduced antibody reactivity established that a reduced induction of immune response occurs once the PEGylated protein is injected into the live animal. Table 33 lists the percent immune reactivity retained in PEGylated SK varinats while taking the reactivity of wild type unmodified SK as 100%. The present invention thus discloses PEGylated streptokinase variants with markedly reduced immunoreactivity but intact thrombolytic potency

ADVANTAGES OF THE INVENTION

The advantage of the present invention lies in its disclosure of the design of cysteine variants of streptokinase its muteins, species variants and covalently modified forms. Site specific PEG conjugation to the cysteine variants disclosed in this invention imparts various useful therapeutic properties to the streptokinase molecule such as increased proteolytic stability, improved in vivo half life and less immune reactivity. More particularly, the invention relates to production of engineered streptokinase derivatives for use in pharmaceutical compositions for treating circulatory disorders.

TABLE 1

Solvent accessibility values for various amino-acid selected for cysteine substitution.

| SK or variant | Location of cysteine mutation | Accessibility |
|---|---|---|
| I 88 | 88-97 loop of alpha domain | 30 |
| S 93 | 88-97 loop of alpha domain | 42 |
| D 95 | 88-97 loop of alpha domain | 132 |
| D 96 | 88-97 loop of alpha domain | 58 |
| D 102 | β4 of alpha domain | 58 |
| S 105 | Preciding the β4' | 123 |
| D 120 | Region between β5 and β6 | 65 |
| K 121 | Region between β5 and β6 domain | 199 |
| D 122 | Region between β5 and β6 of alpha domain | 101 |
| E 148 | Linker region of alpha and beta domain | 118 |
| K 156 | Linker region of alpha and beta domain | 109 |
| D 173 | Loop between β1 and β2 of beta domain | 145 |
| D 174 | Loop between β1 and β2 of beta domain | 111 |
| L 179 | β2 of beta domain | 54 |
| D 181 | At the end of β2 of beta domain | 36 |
| S 205 | α helix (α3,4) of beta domain | 62 |
| N 255 | 250 loop of beta domain | 41 |
| K 256 | 250 loop of beta domain | 174 |
| K 257 | 250 loop of beta domain | 189 |
| S 258 | 250 loop of beta domain | 79 |
| L 260 | 250 loop of beta domain | 112 |
| K 282 | Linker region of beta and gamma domain | 154 |
| F 287 | Linker region of beta and gamma domain | 161 |
| D 303 | β1 of gamma domain | 134 |
| L 321 | Coiled -coil region of gamma domain | 47 |
| L 326 | Coiled -coil region of gamma domain | 12 |
| A 333 | Coiled -coil region of gamma domain | 24 |
| D 347 | β4 of the gamma domain | 53 |
| R 372 | β7 of the gamma domain | 234 |

TABLE 2

Different constructs of SK its muteins and fusion polypeptides that were used for cysteine mutagenesis

| MOLECULE | MODIFICATION |
|---|---|
| SEQ ID NO 1 | nSK (1-414) ATCC 12449 |
| SEQ ID NO 2 | SK (1-383) |
| SEQ ID NO 3 | SK (16-414) |
| SEQ ID NO 4 | SK (16-383) |
| SEQ ID NO 5 | SK (50-414) |
| SEQ ID NO 6 | SK (60-383) |
| SEQ ID NO 7 | SK Asn 90 Ala (1-414) |
| SEQ ID NO 8 | SK Asp 227 Tyr (1-414) |
| SEQ ID NO 9 | SK Asp 238 Ala (1-414) |
| SEQ ID NO 10 | SK Glu 240 Ala (1-414) |
| SEQ ID NO 11 | SK Arg 244 Ala (1-414) |
| SEQ ID NO 12 | SK Lys 246 Ala (1-414) |
| SEQ ID NO 13 | SK Leu 260 Ala (1-414) |
| SEQ ID NO 14 | SK Asp 359 Arg (1-414) |
| SEQ ID NO 15 | SK His, Ser 92,93 Ala, Ala (1-414) |
| SEQ ID NO 16 | SK Lys, Lys 278,279 Ala, Ala (1-414) |
| SEQ ID NO 17 | SK Asn 90 del (1-413) |
| SEQ ID NO 18 | SK Asp 227 del (1-413) |
| SEQ ID NO 19 | SK Asp 359 del (1-413) |
| SEQ ID NO 20 | SK (1-406) *Streptococcus pyogenes* MGAS10270, ABF34818.1 |
| SEQ ID NO 21 | SK (1-414) *Streptococcus dysgalactiae* subsp. *Equisimilis*, AAC60418 |
| SEQ ID NO 22 | Fn SK (1-531) |
| SEQ ID NO 23 | SK Fn (1-502) |
| SEQ ID NO 24 | Fn SK Fn (1-619) |

TABLE 3

Cystein substitution on SK polypeptide (SEQ ID NO 1): 1-414

| | |
|---|---|
| SEQ ID NO 25 | Gly 49 Cys |
| SEQ ID NO 26 | Ser 57 Cys |
| SEQ ID NO 27 | Ala 64 Cys |
| SEQ ID NO 28 | Iie 88 Cys |
| SEQ ID NO 29 | Ser 93 Cys |
| SEQ ID NO 30 | Asp 95 Cys |
| SEQ ID NO 31 | Asp 96 Cys |
| SEQ ID NO 32 | Asp 102 Cys |
| SEQ ID NO 33 | Ser105 Cys |
| SEQ ID NO 34 | Asp 120 Cys |
| SEQ ID NO 35 | Lys 121 Cys |
| SEQ ID NO 36 | Asp 122 Cys |
| SEQ ID NO 37 | Glu 148 Cys |
| SEQ ID NO 38 | Lys 156 Cys |
| SEQ ID NO 39 | Asp 173 Cys |
| SEQ ID NO 40 | Asp 174 Cys |
| SEQ ID NO 41 | Leu 179 Cys |
| SEQ ID NO 42 | Asp 181 Cys |
| SEQ ID NO 43 | Ser 205 Cys |
| SEQ ID NO 44 | Ala 251 Cys |
| SEQ ID NO 45 | Iie 254 Cys |
| SEQ ID NO 46 | Asn 255 Cys |
| SEQ ID NO 47 | Lys 256 Cys |
| SEQ ID NO 48 | Lys 257 Cys |
| SEQ ID NO 49 | Ser258 Cys |
| SEQ ID NO 50 | Leu 260 Cys |
| SEQ ID NO 51 | Glu 281 Cys |
| SEQ ID NO 52 | Lys 282 Cys |
| SEQ ID NO 53 | Phe 287 Cys |
| SEQ ID NO 54 | Asp 303 Cys |
| SEQ ID NO 55 | Leu 321 Cys |
| SEQ ID NO 56 | Leu 326 Cys |
| SEQ ID NO 57 | Ala 333 Cys |
| SEQ ID NO 58 | Asp 347 Cys |
| SEQ ID NO 59 | Asp 360 Cys |
| SEQ ID NO 60 | Arg 372 Cys |
| SEQ ID NO 61 | Iie 88 Cys, Ser 205 Cys |
| SEQ ID NO 62 | Ser 93Cys, Asn 255 Cys |
| SEQ ID NO 63 | Asp 102 Cys, Arg 372 Cys |
| SEQ ID NO 64 | Ser 105 Cys, and Phe 287 Cys |

TABLE 3-continued

Cystein substitution on SK polypeptide (SEQ ID NO 1): 1-414

| | |
|---|---|
| SEQ ID NO 65 | Lys 121 Cys, Asp 360 Cys |
| SEQ ID NO 66 | Iie 88 Cys, Ser 205 Cys, Arg 372 Cys |
| SEQ ID NO 67 | Ser 93 Cys, Asn 255 Cys, Asp 347 Cys |
| SEQ ID NO 68 | Ser 93 Cys, Asn 255 Cys, Phe 287 Cys |
| SEQ ID NO 69 | Asp 102 Cys, Leu 260 Cys, Arg 372 Cys |
| SEQ ID NO 70 | Ser 105 Cys, Leu 260 Cys, Phe 287 Cys |

TABLE 4

Single Cysteine substitution on truncated SK polypeptide (SEQ ID NO 2): 1-383

| MOLECULE | MODIFICATION |
|---|---|
| SEQ ID NO 71 | Gly 49 Cys |
| SEQ ID NO 72 | Ser 57 Cys |
| SEQ ID NO 73 | Ala 64 Cys |
| SEQ ID NO 74 | Ile 88 Cys |
| SEQ ID NO 75 | Ser 93 Cys |
| SEQ ID NO 76 | Asp 95 Cys |
| SEQ ID NO 77 | Asp 96 Cys |
| SEQ ID NO 78 | Asp 102 Cys |
| SEQ ID NO 79 | Ser 105 Cys |
| SEQ ID NO 80 | Asp 120 Cys |
| SEQ ID NO 81 | Lys 121 Cys |
| SEQ ID NO 82 | Asp 122 Cys |
| SEQ ID NO 83 | Glu 148 Cys |
| SEQ ID NO 84 | Lys 156 Cys |
| SEQ ID NO 85 | Asp 173 Cys |
| SEQ ID NO 86 | Asp 174 Cys |
| SEQ ID NO 87 | Leu 179 Cys |
| SEQ ID NO 88 | Asp 181 Cys |
| SEQ ID NO 89 | Ser 205 Cys |
| SEQ ID NO 90 | Ala 251 Cys |
| SEQ ID NO 91 | Ile 254 Cys |
| SEQ ID NO 92 | Asn 255 Cys |
| SEQ ID NO 93 | Lys 256 Cys |
| SEQ ID NO 94 | Lys 257 Cys |
| SEQ ID NO 95 | Ser 258 Cys |
| SEQ ID NO 96 | Leu 260 Cys |
| SEQ ID NO 97 | Glu 281 Cys |
| SEQ ID NO 98 | Lys 282 Cys |
| SEQ ID NO 99 | Phe 287 Cys |
| SEQ ID NO 100 | Asp 303 Cys |
| SEQ ID NO 101 | Leu 321 Cys |
| SEQ ID NO 102 | Leu 326 Cys |
| SEQ ID NO 103 | Ala 333 Cys |
| SEQ ID NO 104 | Asp 347 Cys |
| SEQ ID NO 105 | Asp 360 Cys |
| SEQ ID NO 106 | Arg 372 Cys |
| SEQ ID NO 107 | Ile 88 Cys, Ser 205 Cys |
| SEQ ID NO 108 | Ser 93Cys, Asn 255 Cys |
| SEQ ID NO 109 | Asp 102 Cys, Arg 372 Cys |
| SEQ ID NO 110 | Ser 105 Cys, and Phe 287 Cys |
| SEQ ID NO 111 | Lys 121 Cys, Asp 360 Cys |
| SEQ ID NO 112 | Ile 88 Cys, Ser 205 Cys, Arg 372 Cys |
| SEQ ID NO 113 | Ser 93 Cys, Asn 255 Cys, Asp 347 Cys |
| SEQ ID NO 114 | Ser 93 Cys, Asn 255 Cys, Phe 287 Cys |
| SEQ ID NO 115 | Asp 102 Cys, Leu 260 Cys, Arg 372 Cys |
| SEQ ID NO 116 | Ser 105 Cys, Leu 260 Cys, Phe 287 Cys |

TABLE 5

Single Cysteine substitution on truncated SK polypeptide (SEQ ID NO 3)[[: 16-414]]

| MOLECULE | MODIFICATION |
|---|---|
| SEQ ID NO 117 | Gly 34 Cys |
| SEQ ID NO 118 | Ser 42 Cys |
| SEQ ID NO 119 | Ala 49 Cys |
| SEQ ID NO 120 | Ile 73 Cys |
| SEQ ID NO 121 | Ser 78 Cys |
| SEQ ID NO 122 | Asp 80 Cys |
| SEQ ID NO 123 | Asp 81 Cys |
| SEQ ID NO 124 | Asp 87 Cys |
| SEQ ID NO 125 | Ser 90 Cys |
| SEQ ID NO 126 | Asp 105 Cys |
| SEQ ID NO 127 | Lys 106 Cys |
| SEQ ID NO 128 | Asp 107 Cys |
| SEQ ID NO 129 | Glu 133 Cys |
| SEQ ID NO 130 | Lys 141 Cys |
| SEQ ID NO 131 | Asp 158 Cys |
| SEQ ID NO 132 | Asp 159 Cys |
| SEQ ID NO 133 | Leu 164 Cys |
| SEQ ID NO 134 | Asp 166 Cys |
| SEQ ID NO 135 | Ser 190 Cys |
| SEQ ID NO 136 | Ala 236 Cys |
| SEQ ID NO 137 | Ile 239 Cys |
| SEQ ID NO 138 | Asn 240 Cys |
| SEQ ID NO 139 | Lys 241 Cys |
| SEQ ID NO 140 | Lys 242 Cys |
| SEQ ID NO 141 | Ser 243 Cys |
| SEQ ID NO 142 | Leu 245 Cys |
| SEQ ID NO 143 | Glu 266 Cys |
| SEQ ID NO 144 | Lys 267 Cys |
| SEQ ID NO 145 | Phe 272 Cys |
| SEQ ID NO 146 | Asp 288 Cys |
| SEQ ID NO 147 | Leu 306 Cys |
| SEQ ID NO 148 | Leu 311 Cys |
| SEQ ID NO 149 | Ala 318 Cys |
| SEQ ID NO 150 | Asp 332 Cys |
| SEQ ID NO 151 | Asp 345 Cys |
| SEQ ID NO 152 | Arg 357 Cys |
| SEQ ID NO 153 | Ile 73 Cys, Ser 190 Cys |
| SEQ ID NO 154 | Ser 78Cys, Asn 240 Cys |
| SEQ ID NO 155 | Asp 87 Cys, Arg 357 Cys |
| SEQ ID NO 156 | Ser 90 Cys, and Phe 272 Cys |
| SEQ ID NO 157 | Lys 106 Cys, Asp 345 Cys |
| SEQ ID NO 158 | Ile 73 Cys, Ser 190 Cys, Arg 357 Cys |
| SEQ ID NO 159 | Ser 78 Cys, Asn 240 Cys, Asp Cys |
| SEQ ID NO 160 | Ser 78 Cys, Asn 240 Cys, Phe 272 Cys |
| SEQ ID NO 161 | Asp 87 Cys, Leu 245 Cys, Arg 357 Cys |
| SEQ ID NO 162 | Ser 90 Cys, Leu 245 Cys, Phe 272 Cys |

TABLE 6

Single Cysteine substitution on truncated SK polypeptide (SEQ ID NO 4)[[:16-383]]

| MOLECULE | MODIFICATION |
|---|---|
| SEQ ID NO 163 | Gly 34 Cys |
| SEQ ID NO 164 | Ser 42 Cys |
| SEQ ID NO 165 | Ala 49 Cys |
| SEQ ID NO 166 | Ile 73 Cys |
| SEQ ID NO 167 | Ser 78 Cys |
| SEQ ID NO 168 | Asp 80 Cys |
| SEQ ID NO 169 | Asp 81 Cys |
| SEQ ID NO 170 | Asp 87 Cys |
| SEQ ID NO 171 | Ser 90 Cys |
| SEQ ID NO 172 | Asp 105 Cys |
| SEQ ID NO 173 | Lys 106 Cys |
| SEQ ID NO 174 | Asp 107 Cys |
| SEQ ID NO 175 | Glu 133 Cys |
| SEQ ID NO 176 | Lys 141 Cys |
| SEQ ID NO 177 | Asp 158 Cys |
| SEQ ID NO 178 | Asp 159 Cys |
| SEQ ID NO 179 | Leu 164 Cys |
| SEQ ID NO 180 | Asp 166 Cys |
| SEQ ID NO 181 | Ser 190 Cys |
| SEQ ID NO 182 | Ala 236 Cys |
| SEQ ID NO 183 | Ile 239 Cys |
| SEQ ID NO 184 | Asn 240 Cys |

TABLE 6-continued

| Single Cysteine substitution on truncated SK polypeptide (SEQ ID NO 4)[[:16-383]] | |
|---|---|
| MOLECULE | MODIFICATION |
| SEQ ID NO 185 | Lys 241 Cys |
| SEQ ID NO 186 | Lys 242 Cys |
| SEQ ID NO 187 | Ser 243 Cys |
| SEQ ID NO 188 | Leu 245 Cys |
| SEQ ID NO 189 | Glu 266 Cys |
| SEQ ID NO 190 | Lys 267 Cys |
| SEQ ID NO 191 | Phe 272 Cys |
| SEQ ID NO 192 | Asp 288 Cys |
| SEQ ID NO 193 | Leu 306 Cys |
| SEQ ID NO 194 | Leu 311 Cys |
| SEQ ID NO 195 | Ala 318 Cys |
| SEQ ID NO 196 | Asp 332 Cys |
| SEQ ID NO 197 | Asp 345 Cys |
| SEQ ID NO 198 | Arg 357 Cys |
| SEQ ID NO 199 | Ile 73 Cys, Ser 190 Cys |
| SEQ ID NO 200 | Ser 78Cys, Asn 240 Cys |
| SEQ ID NO 201 | Asp 87 Cys, Arg 357 Cys |
| SEQ ID NO 202 | Ser 90 Cys, and Phe 272 Cys |
| SEQ ID NO 203 | Lys 106 Cys, Asp 345 Cys |
| SEQ ID NO 204 | Ile 73 Cys, Ser 190 Cys, Arg 357 Cys |
| SEQ ID NO 205 | Ser 78 Cys, Asn 240 Cys, Asp Cys |
| SEQ ID NO 206 | Ser 78 Cys, Asn 240 Cys, Phe 272 Cys |
| SEQ ID NO 207 | Asp 87 Cys, Leu 245 Cys, Arg 357 Cys |
| SEQ ID NO 208 | Ser 90 Cys, Leu 245 Cys, Phe 272 Cys |

TABLE 7

| Single Cysteine substitution on truncated SK polypeptide (SEQ ID NO 5)[[: 50-414]] | |
|---|---|
| MOLECULE | MODIFICATION |
| SEQ ID NO 209 | Ala 15 Cys |
| SEQ ID NO 210 | Ile 39 Cys |
| SEQ ID NO 211 | Ser 44 Cys |
| SEQ ID NO 212 | Asp 46 Cys |
| SEQ ID NO 213 | Asp 47 Cys |
| SEQ ID NO 214 | Asp 53 Cys |
| SEQ ID NO 215 | Ser 56 Cys |
| SEQ ID NO 216 | Asp 71 Cys |
| SEQ ID NO 217 | Lys 72 Cys |
| SEQ ID NO 218 | Asp 73 Cys |
| SEQ ID NO 219 | Glu 99 Cys |
| SEQ ID NO 220 | Lys 107 Cys |
| SEQ ID NO 221 | Asp 124 Cys |
| SEQ ID NO 222 | Asp 125 Cys |
| SEQ ID NO 223 | Leu 130 Cys |
| SEQ ID NO 224 | Asp 132 Cys |
| SEQ ID NO 225 | Ser 156 Cys |
| SEQ ID NO 226 | Ala 202 Cys |
| SEQ ID NO 227 | Ile 205 Cys |
| SEQ ID NO 228 | Asn 206 Cys |
| SEQ ID NO 229 | Lys 207 Cys |
| SEQ ID NO 230 | Lys 208 Cys |
| SEQ ID NO 231 | Ser 209 Cys |
| SEQ ID NO 232 | Leu 211 Cys |
| SEQ ID NO 233 | Glu 232 Cys |
| SEQ ID NO 234 | Lys 233 Cys |
| SEQ ID NO 235 | Phe 238 Cys |
| SEQ ID NO 236 | Asp 254 Cys |
| SEQ ID NO 237 | Leu 272 Cys |
| SEQ ID NO 238 | Leu 277 Cys |
| SEQ ID NO 239 | Ala 284 Cys |
| SEQ ID NO 240 | Asp 298 Cys |
| SEQ ID NO 241 | Asp 311 Cys |
| SEQ ID NO 242 | Arg 323 Cys |
| SEQ ID NO 243 | Ile 39 Cys, Ser 156 Cys |
| SEQ ID NO 244 | Ser 44 Cys, Asn 206 Cys |
| SEQ ID NO 245 | Asp 53 Cys, Arg 323 Cys |
| SEQ ID NO 246 | Ser 56 Cys, and Phe 238 Cys |
| SEQ ID NO 247 | Lys 72 Cys, Asp 311 Cys |
| SEQ ID NO 248 | Ile 39 Cys, Ser 156 Cys, Arg 323 Cys |

TABLE 7-continued

| Single Cysteine substitution on truncated SK polypeptide (SEQ ID NO 5)[[: 50-414]] | |
|---|---|
| MOLECULE | MODIFICATION |
| SEQ ID NO 249 | Ser 44 Cys, Asn 206 Cys, Asp 298 Cys |
| SEQ ID NO 250 | Ser 44 Cys, Asn 206 Cys, Phe 238 Cys |
| SEQ ID NO 251 | Asp 53 Cys, Leu 211 Cys, Arg 323 Cys |
| SEQ ID NO 252 | Ser 56 Cys, Leu 211 Cys, Phe 238 Cys |

TABLE 8

| Single Cysteine substitution on truncated SK polypeptide (SEQ ID NO 6)[[: 60-383]] | |
|---|---|
| MOLECULE | MODIFICATION |
| SEQ ID NO 253 | Ala 5 Cys |
| SEQ ID NO 254 | Ile 29 Cys |
| SEQ ID NO 255 | Ser 34 Cys |
| SEQ ID NO 256 | Asp 36 Cys |
| SEQ ID NO 257 | Asp 37 Cys |
| SEQ ID NO 258 | Asp 43 Cys |
| SEQ ID NO 259 | Ser 46 Cys |
| SEQ ID NO 260 | Asp 61 Cys |
| SEQ ID NO 261 | Lys 62 Cys |
| SEQ ID NO 262 | Asp 63 Cys |
| SEQ ID NO 263 | Glu 89 Cys |
| SEQ ID NO 264 | Lys 97 Cys |
| SEQ ID NO 265 | Asp 114 Cys |
| SEQ ID NO 266 | Asp 115 Cys |
| SEQ ID NO 267 | Leu 120 Cys |
| SEQ ID NO 268 | Asp 122 Cys |
| SEQ ID NO 269 | Ser 146 Cys |
| SEQ ID NO 270 | Ala 192 Cys |
| SEQ ID NO 271 | Ile 195 Cys |
| SEQ ID NO 272 | Asn 196 Cys |
| SEQ ID NO 273 | Lys 197 Cys |
| SEQ ID NO 274 | Lys 198 Cys |
| SEQ ID NO 275 | Ser 199 Cys |
| SEQ ID NO 276 | Leu 201 Cys |
| SEQ ID NO 277 | Glu 222 Cys |
| SEQ ID NO 278 | Lys 223 Cys |
| SEQ ID NO 279 | Phe 228 Cys |
| SEQ ID NO 280 | Asp 244 Cys |
| SEQ ID NO 281 | Leu 262 Cys |
| SEQ ID NO 282 | Leu 267 Cys |
| SEQ ID NO 283 | Ala 274 Cys |
| SEQ ID NO 284 | Asp 188 Cys |
| SEQ ID NO 285 | Asp 301 Cys |
| SEQ ID NO 286 | Arg 313 Cys |
| SEQ ID NO 287 | Ile 29 Cys, Ser 146 Cys |
| SEQ ID NO 288 | Ser 34Cys, Asn 196 Cys |
| SEQ ID NO 289 | Asp 43 Cys, Arg 313 Cys |
| SEQ ID NO 290 | Ser 46 Cys, and Phe 228 Cys |
| SEQ ID NO 291 | Lys 62 Cys, Asp 301 Cys |
| SEQ ID NO 292 | Ile 29 Cys, Ser 146 Cys, Arg 313 Cys |
| SEQ ID NO 293 | Ser 34 Cys, Asn 196 Cys, Asp 288 Cys |
| SEQ ID NO 294 | Ser 34 Cys, Asn 196 Cys, Phe 228 Cys |
| SEQ ID NO 295 | Asp 43 Cys, Leu 201 Cys, Arg 313 Cys |
| SEQ ID NO 296 | Ser 46 Cys, Leu 201 Cys, Phe 228 Cys |

TABLE 9

| Cysteine variants of SK 1-414 mutein, Asn 90 Ala: (SEQ ID NO 7) | |
|---|---|
| MOLECULE | MODIFICATION |
| SEQ ID NO 297 | Asp 102 Cys |
| SEQ ID NO 298 | Leu 260 Cys |
| SEQ ID NO 299 | Asp 347 Cys |

TABLE 10

| Cysteine variants of SK (1-414) mutein, Asp 227 Tyr: (SEQ ID NO 8) | |
|---|---|
| MOLECULE | MODIFICATION |
| SEQ ID NO 300 | Asp 102 Cys |
| SEQ ID NO 301 | Leu 260 Cys |
| SEQ ID NO 302 | Asp 347 Cys |

TABLE 11

| Cysteine variants of SK (1-414) mutein, Asp 238 Ala: (SEQ ID NO 9) | |
|---|---|
| MOLECULE | MODIFICATION |
| SEQ ID NO 303 | Asp 102 Cys |
| SEQ ID NO 304 | Leu 260 Cys |
| SEQ ID NO 305 | Asp 347 Cys |

TABLE 12

| Cysteine variants of SK (1-414) mutein, Glu 240 Ala: (SEQ ID NO 10) | |
|---|---|
| MOLECULE | MODIFICATION |
| SEQ ID NO 306 | Asp 102 Cys |
| SEQ ID NO 307 | Leu 260 Cys |
| SEQ ID NO 308 | Asp 347 Cys |

TABLE 13

| Cysteine variants of SK (1-414) mutein, Arg 244 Ala: (SEQ ID NO 11) | |
|---|---|
| MOLECULE | MODIFICATION |
| SEQ ID NO 309 | Asp 102 Cys |
| SEQ ID NO 310 | Leu 260 Cys |
| SEQ ID NO 311 | Asp 347 Cys |

TABLE 14

| Cysteine variants of SK (1-414) mutein, Lys 246 Ala: (SEQ ID NO 12) | |
|---|---|
| MOLECULE | MODIFICATION |
| SEQ ID NO 312 | Asp 102 Cys |
| SEQ ID NO 313 | Leu 260 Cys |
| SEQ ID NO 314 | Asp 347 Cys |

TABLE 15

| Cysteine variants of SK (1-414) mutein, Leu 260 Ala: (SEQ ID NO 13) | |
|---|---|
| MOLECULE | MODIFICATION |
| SEQ ID NO 315 | Asp 102 Cys |
| SEQ ID NO 316 | Asn 255 Cys |
| SEQ ID NO 317 | Asp 347 Cys |

TABLE 16

| Cysteine variants of SK (1-414) mutein, Asp 359 Arg: (SEQ ID NO 14) | |
|---|---|
| MOLECULE | MODIFICATION |
| SEQ ID NO 318 | Asp 102 Cys |
| SEQ ID NO 319 | Leu 260 Cys |
| SEQ ID NO 320 | Asp 347 Cys |

TABLE 17

| Cysteine variants of SK (1-414) mutein, His, Ser, 92, 93 Ala, Ala: (SEQ ID NO 15) | |
|---|---|
| MOLECULE | MODIFICATION |
| SEQ ID NO 321 | Asp 102 Cys |
| SEQ ID NO 322 | Leu 260 Cys |
| SEQ ID NO 323 | Asp 347 Cys |

TABLE 18

| Cysteine variants of SK (1-414) mutein, Lys, Lys 278, 279 Ala, Ala: (SEQ ID NO 16) | |
|---|---|
| MOLECULE | MODIFICATION |
| SEQ ID NO 324 | Asp 102 Cys |
| SEQ ID NO 325 | Leu 260 Cys |
| SEQ ID NO 326 | Asp 347 Cys |

TABLE 19

| Cysteine variants of SK (1-413) mutein, Asn 90 del: (SEQ ID NO 17) | |
|---|---|
| MOLECULE | MODIFICATION |
| SEQ ID NO 327 | Asp 101 Cys |
| SEQ ID NO 328 | Leu 259 Cys |
| SEQ ID NO 329 | Asp 346 Cys |

TABLE 20

| Cysteine variants of SK (1-413) mutein, Asp 227 del: (SEQ ID NO 18) | |
|---|---|
| MOLECULE | MODIFICATION |
| SEQ ID NO 330 | Asp 102 Cys |
| SEQ ID NO 331 | Leu 259 Cys |
| SEQ ID NO 332 | Asp 346 Cys |

TABLE 21

| Cysteine variants of SK (1-413) mutein, Asp 359 del: (SEQ ID NO 19) | |
|---|---|
| MOLECULE | MODIFICATION |
| SEQ ID NO 333 | Asp 102 Cys |
| SEQ ID NO 334 | Leu 260 Cys |
| SEQ ID NO 335 | Asp 347 Cys |

TABLE 22

| Cysteine variants of *Streptococcus* pyogenes MGAS10270 (SEQ ID NO 20) | |
|---|---|
| MOLECULE | MODIFICATION |
| SEQ ID NO 336 | Ile 80 Cys |
| SEQ ID NO 337 | Ser 85 Cys |
| SEQ ID NO 338 | Asp 94 Cys |
| SEQ ID NO 339 | Ile 246 Cys |
| SEQ ID NO 340 | Asp 339 Cys |
| SEQ ID NO 341 | Arg 364 Cys |

TABLE 23

| Cysteine variants of *Streptococcus dysgalactiae* subsp. *equisimilis* (SEQ ID NO 21) | |
|---|---|
| MOLECULE | MODIFICATION |
| SEQ ID NO 342 | Ile 88 Cys |
| SEQ ID NO 343 | Ser 93 Cys |
| SEQ ID NO 344 | Asp 102 Cys |
| SEQ ID NO 345 | Leu 260 Cys |
| SEQ ID NO 346 | Asp 347 Cys |
| SEQ ID NO 347 | Arg 372 Cys |

TABLE 24

| Cysteine variants of polypeptide where fibrin domain is fused to N-terminus of SK (SEQ ID NO 22)[[: 1-531]] | |
|---|---|
| MOLECULE | MODIFICATION |
| SEQ ID NO 348 | His 16 Cys |
| SEQ ID NO 349 | Ala 17 Cys |
| SEQ ID NO 350 | Asp 62 Cys |
| SEQ ID NO 351 | Gly 80 Cys |
| SEQ ID NO 352 | Gly 166 Cys |
| SEQ ID NO 353 | Ser 174 Cys |
| SEQ ID NO 354 | Ala 181 Cys |
| SEQ ID NO 355 | Ile 205 Cys |
| SEQ ID NO 356 | Ser 210 Cys |
| SEQ ID NO 357 | Asp 212 Cys |
| SEQ ID NO 358 | Asp 213 Cys |
| SEQ ID NO 359 | Asp 219 Cys |
| SEQ ID NO 360 | Ser 222 Cys |
| SEQ ID NO 361 | Asp 237 Cys |
| SEQ ID NO 362 | Lys 238 Cys |
| SEQ ID NO 363 | Asp 239 Cys |
| SEQ ID NO 364 | Glu 265 Cys |
| SEQ ID NO 365 | Lys 273 Cys |
| SEQ ID NO 366 | Asp 290 Cys |
| SEQ ID NO 367 | Asp 291 Cys |
| SEQ ID NO 368 | Leu 296 Cys |
| SEQ ID NO 369 | Asp 298 Cys |
| SEQ ID NO 370 | Ser 322 Cys |
| SEQ ID NO 371 | Ile 371 Cys |
| SEQ ID NO 372 | Asn 372 Cys |
| SEQ ID NO 373 | Lys 373 Cys |
| SEQ ID NO 374 | Lys 374 Cys |
| SEQ ID NO 375 | Ser 375 Cys |
| SEQ ID NO 376 | Leu 377 Cys |
| SEQ ID NO 377 | Glu 398 Cys |
| SEQ ID NO 378 | Lys 399 Cys |
| SEQ ID NO 379 | Phe 404 Cys |
| SEQ ID NO 380 | Asp 420 Cys |
| SEQ ID NO 381 | Leu 438 Cys |
| SEQ ID NO 382 | Leu 443 Cys |
| SEQ ID NO 383 | Ala 450 Cys |
| SEQ ID NO 384 | Asp 464 Cys |
| SEQ ID NO 385 | Asp 477 Cys |
| SEQ ID NO 386 | Arg 489 Cys |
| SEQ ID NO 387 | His 16 Cys, Ile 205 Cys |
| SEQ ID NO 388 | His 16 Cys, Ser 322 Cys |
| SEQ ID NO 389 | His 16 Cys, Leu 377 Cys |
| SEQ ID NO 390 | His 16 Cys, Arg 489 Cys |

TABLE 25

| Cysteine variants of polypeptide where fibrin domain is fused to C-terminal of SK (SEQ ID NO 23): 1-502 | |
|---|---|
| MOLECULE | MODIFICATION |
| SEQ ID NO 391 | Gly 49 Cys |
| SEQ ID NO 392 | Ser 57 Cys |
| SEQ ID NO 393 | Ala 64 Cys |
| SEQ ID NO 394 | Ile 88 Cys |

TABLE 25-continued

| Cysteine variants of polypeptide where fibrin domain is fused to C-terminal of SK (SEQ ID NO 23): 1-502 | |
|---|---|
| MOLECULE | MODIFICATION |
| SEQ ID NO 395 | Ser 93 Cys |
| SEQ ID NO 396 | Asp 95 Cys |
| SEQ ID NO 397 | Asp 96 Cys |
| SEQ ID NO 398 | Asp 102 Cys |
| SEQ ID NO 399 | Ser 105 Cys |
| SEQ ID NO 400 | Asp 120 Cys |
| SEQ ID NO 401 | Lys 121 Cys |
| SEQ ID NO 402 | Asp 122 Cys |
| SEQ ID NO 403 | Glu 148 Cys |
| SEQ ID NO 404 | Lys 156 Cys |
| SEQ ID NO 405 | Asp 173 Cys |
| SEQ ID NO 406 | Asp 174 Cys |
| SEQ ID NO 407 | Leu 179 Cys |
| SEQ ID NO 408 | Asp 181 Cys |
| SEQ ID NO 409 | Ser 205 Cys |
| SEQ ID NO 410 | Ala 251 Cys |
| SEQ ID NO 411 | Ile 254 Cys |
| SEQ ID NO 412 | Asn 255 Cys |
| SEQ ID NO 413 | Lys 256 Cys |
| SEQ ID NO 414 | Lys 257 Cys |
| SEQ ID NO 415 | Ser 258 Cys |
| SEQ ID NO 416 | Leu 260 Cys |
| SEQ ID NO 417 | Glu 281 Cys |
| SEQ ID NO 418 | Lys 282 Cys |
| SEQ ID NO 419 | Phe 287 Cys |
| SEQ ID NO 420 | Asp 303 Cys |
| SEQ ID NO 421 | Leu 321 Cys |
| SEQ ID NO 422 | Leu 326 Cys |
| SEQ ID NO 423 | Ala 333 Cys |
| SEQ ID NO 424 | Asp 347 Cys |
| SEQ ID NO 425 | Asp 360 Cys |
| SEQ ID NO 426 | Arg 372 Cys |
| SEQ ID NO 427 | His 401 Cys |
| SEQ ID NO 428 | Ala 402 Cys |
| SEQ ID NO 429 | Asp 447 Cys |
| SEQ ID NO 430 | Gly 465 Cys |
| SEQ ID NO 431 | Ile 88 Cys, His 401 Cys |
| SEQ ID NO 432 | Ser 205 Cys, His 401 Cys |
| SEQ ID NO 433 | Leu 260 Cys, His 401 Cys |
| SEQ ID NO 434 | Arg 372 Cys, His 401 Cys |

TABEL 26

| Cysteine variants of polypeptide where fibrin domain is fused to both N and C-terminus of SK (SEQ ID NO 24): 1-619 | |
|---|---|
| MOLECULE | MODIFICATION |
| SEQ ID NO 435 | His 16 Cys |
| SEQ ID NO 436 | Ala 17 Cys |
| SEQ ID NO 437 | Asp 62 Cys |
| SEQ ID NO 438 | Gly 80 Cys |
| SEQ ID NO 439 | Gly 166 Cys |
| SEQ ID NO 440 | Ser 174 Cys |
| SEQ ID NO 441 | Ala 181 Cys |
| SEQ ID NO 442 | Ile 205 Cys |
| SEQ ID NO 443 | Ser 210 Cys |
| SEQ ID NO 444 | Asp 212 Cys |
| SEQ ID NO 445 | Asp 213 Cys |
| SEQ ID NO 446 | Asp 219 Cys |
| SEQ ID NO 447 | Ser 222 Cys |
| SEQ ID NO 448 | Asp 237 Cys |
| SEQ ID NO 449 | Lys 238 Cys |
| SEQ ID NO 450 | Asp 239 Cys |
| SEQ ID NO 451 | Glu 265 Cys |
| SEQ ID NO 452 | Lys 273 Cys |
| SEQ ID NO 453 | Asp 290 Cys |
| SEQ ID NO 454 | Asp 291 Cys |
| SEQ ID NO 455 | Leu 296 Cys |
| SEQ ID NO 456 | Asp 298 Cys |
| SEQ ID NO 457 | Ser 322 Cys |
| SEQ ID NO 458 | Ile 371 Cys |

TABEL 26-continued

| Cysteine variants of polypeptide where fibrin domain is fused to both N and C-terminus of SK (SEQ ID NO 24): 1-619 | |
|---|---|
| MOLECULE | MODIFICATION |
| SEQ ID NO 459 | Asn 372 Cys |
| SEQ ID NO 460 | Lys 373 Cys |
| SEQ ID NO 461 | Lys 374 Cys |
| SEQ ID NO 462 | Ser 375 Cys |
| SEQ ID NO 463 | Leu 377 Cys |
| SEQ ID NO 464 | Glu 398 Cys |
| SEQ ID NO 465 | Lys 399 Cys |
| SEQ ID NO 466 | Phe 404 Cys |
| SEQ ID NO 467 | Asp 420 Cys |
| SEQ ID NO 468 | Leu 438 Cys |
| SEQ ID NO 469 | Leu 443 Cys |
| SEQ ID NO 470 | Ala 450 Cys |
| SEQ ID NO 471 | Asp 464 Cys |
| SEQ ID NO 472 | Asp 477 Cys |
| SEQ ID NO 473 | Arg 489 Cys |
| SEQ ID NO 474 | His 518 Cys |
| SEQ ID NO 475 | Ala 519 Cys |
| SEQ ID NO 476 | Asp 564 Cys |
| SEQ ID NO 477 | Gly 582 Cys |
| SEQ ID NO 478 | His 16 Cys, Leu 377 Cys |
| SEQ ID NO 479 | His 16 Cys, Ser 322 Cys, |
| SEQ ID NO 480 | His 16 Cys, His 518 Cys |
| SEQ ID NO 481 | Ala 17 Cys, Ala 519 Cys |
| SEQ ID NO 482 | Asp 62 Cys, Asp 564 Cys |
| SEQ ID NO 483 | Gly 80 Cys, Gly 582 Cys |
| SEQ ID NO 484 | His 16 Cys, Leu 377 Cys, Arg 489 Cys |
| SEQ ID NO 485 | His 16 Cys, Leu 377 Cys, His 518 Cys |

TABLE 27

| Cysteine insertion mutants of SK | |
|---|---|
| MOLECULE | MODIFICATION |
| SEQ ID NO 486 | Cys between Ile 88 and Ala 89 of SK |
| SEQ ID NO 487 | Cys between Lys 256 and Lys 257 of SK |
| SEQ ID NO 488 | Cys between Asp 347 and Tyr 348 of SK |

TABLE 28

| Cysteine variants of SK where Cys is placed at the termini of SK or its functional fragment with or without a peptide extension | |
|---|---|
| MOLECULE | MODIFICATION |
| SEQ ID NO 489 | Cys at N − 1 position in SK |
| SEQ ID NO 490 | Cys at C + 1 position in SK |
| SEQ ID NO 491 | Cys at N − 1 and at C + 1 position in SK |

TABLE 28-continued

| Cysteine variants of SK where Cys is placed at the termini of SK or its functional fragment with or without a peptide extension | |
|---|---|
| MOLECULE | MODIFICATION |
| SEQ ID NO 492 | Cys at C + 1 position of SEQ ID (1-383, G3 of SK) |
| SEQ ID NO 493 | Cys at N − 1 and at C + 1 position in SK (1-383, G3) |
| SEQ ID NO 494 | Cys in N-terminally His tagged SK |
| SEQ ID NO 495 | Cys at C-terminally His tagged SK |
| SEQ ID NO 496 | Cys with Additional 20 aa tag of pET 15b before Ile |

TABLE 29

Steady-state kinetic parameters for some representative PEGylated cysteine variants of PEGylated streptokinases. Activity of native SK is being taken as 100% to compare the activities of variants

| SEQ ID NO | Activator protein | % Plasminogen activation | Km (μM) |
|---|---|---|---|
| SEQ ID NO 1 | nSK | 100 | 0.4 ± 0.1 |
| SEQ ID NO 489 | N-Cys | 88 ± 5 | 0.4 ± 0.05 |
| SEQ ID NO 30 | SK D95C | 96 ± 6 | 0.5 ± 0.05 |
| SEQ ID NO 31 | SK D96C | 98 ± 4 | 0.5 ± 0.05 |
| SEQ ID NO 32 | SK D102C | 74 ± 4 | 0.5 ± 0.1 |
| SEQ ID NO 33 | SK S105C | 76 ± 5 | 0.5 ± 0.12 |
| SEQ ID NO 35 | SK K121C | 95 ± 5 | 0.4 ± 0.11 |
| SEQ ID NO 39 | SK D173C | 72 ± 4 | 0.4 ± 0.11 |
| SEQ ID NO 41 | SK L179C | 22 ± 3 | 0.5 ± 0.12 |
| SEQ ID NO 46 | SK N255C | 98 ± 3 | 0.4 ± 0.13 |
| SEQ ID NO 48 | SK N257C | 92 ± 4 | 0.4 ± 0.10 |
| SEQ ID NO 49 | L258C | 100 ± 6 | 0.5 ± 0.11 |
| SEQ ID NO 50 | L260C | 100 ± 6 | 0.6 ± 0.12 |
| SEQ ID NO 492 | C-383 Cys | 92 ± 4 | 0.4 ± 0.05 |
| SEQ ID NO 490 | C-Cys | 95 ± 5 | 0.4 ± 0.06 |

TABLE 30

Steady state kinetic parameters for HPG activation by PEGylatedCysteine variants of fibrin domain fusion forms of SK*

| PEG Variants of SEQ ID NO | Molecule | Lag (min) | Km (μM) | % Plasminogen# Activation |
|---|---|---|---|---|
| SEQ ID NO 22 | SK Fn | 10 | 0.25-0.6 | 80-100 |
| SEQ ID NO 23 | Fn SK | 08 | 0.24-0.63 | 60-100 |
| SEQ ID NO 24 | Fn SK Fn | 18 | 0.48 ± 1.0 | 60-80 |

*The parameters were calculated from the linear phases of the reaction progress curves after abolishment of the lag phase.
#Expressed relative to the activity of native SK from *streptococcus* sp. (ATCC 12,499), taken as 100%

TABLE 31

Steady-state kinetics parameters for HPG activation by SK and the bi-pegylated SK variants. Activity of native SK is being taken as 100% to compare the activities of variants

| SEQ ID NO | Molecule | Lag (min) | Km (μM) | % Plasminogen Activation | % Plasminogen Activation* |
|---|---|---|---|---|---|
| SEQ ID NO 1 | nSK | 1 | 0.45 ± 0.02 | 100 | 100 |
| SEQ ID NO 491 | bi-pegylated NC 1-414 | 14 | 0.42 ± 0.03 | <5 | 88 ± 4 |

*plasminogen activation ability when the SK or variants were pre-complexed with equimolar plasmin to make SK.PN enzyme complex.

TABLE 32

| In vivo half-life in mice for different PEGylated variants of SK and Clot-specific SK | | | |
|---|---|---|---|
| SEQ ID NO | Molecule | Site of mutation | Half life (t½) |
| SEQ ID NO 1 | nSK | — | <15 min |
| SEQ ID NO 489 | N-cys | Just after start codon methionine | >3 hrs |
| SEQ ID NO 30 | D 95 C | 88-97 loop of alpha domain | >4 hrs |
| SEQ ID NO 31 | D 96 C | 88-97 loop of alpha domain | >4 hrs |
| SEQ ID NO 48 | K 257 C | 250 loop of beta domain | >2 hrs |
| SEQ ID NO 49 | S 258 C | 250 loop of beta domain | >2 hrs |
| SEQ ID NO 50 | L 260 C | 250 loop of beta domain | >2 hrs |
| SEQ ID NO 487 | KK 256, 257 KCK | Inserted between Lys 256 and Lys 257 of the 250 loop of beta domain | >2 hrs |
| SEQ ID NO 55 | L 321 C | Coiled - coil region of gamma domain | >1 hr |
| SEQ ID NO 58 | D 347 C | β4 of the gamma domain | >1 hr |
| SEQ ID NO 492 | C-383 Cys | C-terminal truncation at 383 position and cysteine placed after three glycine residues | >1 hr |
| SEQ ID NO 490 | C-cys | Cysteine after the C-terminal amino-acid | >1 hr |
| SEQ ID NO 491 | bi-pegylated NC 1-414 | cysteine both at N and C-terminus | >6 hrs |
| SEQ ID NO 493 | bi-pegylated NC 1-383 | Cysteine at N-terminus and at the C-terminus where cysteine is placed after three Gly following truncation at 383 | >6 hrs |

TABLE 33

| Immune reactivity of PEGylated cysteine variants of Streptokinase | | |
|---|---|---|
| SEQ ID NO | PEG variant | Immune reactivity* |
| SEQ ID NO 30 | D95C | 15 ± 2 |
| SEQ ID NO 31 | D96C | 14 ± 2.5 |
| SEQ ID NO 37 | E148C | 16 ± 5 |
| SEQ ID NO 38 | K156C | 22 ± 4 |
| SEQ ID NO 41 | L179C | 17 ± 5 |
| SEQ ID NO 43 | S205C | 19 ± 3 |
| SEQ ID NO 50 | L260C | 17 ± 2 |
| SEQ ID NO 490 | C-Cys | 19 ± 2 |
| SEQ ID NO 491 | N Cys C Cys | 7 ± 1 |
| SEQ ID NO 62 | S93C, N255C | 2 ± .02 |
| SEQ ID NO 63 | D102C, R372C | 2.5 ± .02 |
| SEQ ID NO 61 | I88C, S205C | 2 ± .05 |
| SEQ ID NO 67 | S93C, N255C, D347C | <1 |
| SEQ ID NO 68 | S93C, N255C, F287C | <1 |

*Immune reactivity were measured against anti SK antibodies raised in rabbit. Values are presented in % reactivity retained while taking wild type reactivity as 100%.

TABLE 34

| Highly buried residues of Streptokinase unsuitable for substitution and further modification (SEQ ID NO: 1) | | |
|---|---|---|
| Residue No. in SEQ ID 1 | Amino-acid | Surface accessibility |
| 18 | L | 0 |
| 19 | V | 0 |
| 20 | V | 1 |
| 22 | V | 8 |
| 24 | G | 5 |
| 42 | L | 0 |
| 79 | L | 9 |
| 83 | I | 2 |
| 87 | L | 4 |
| 97 | Y | 9 |
| 124 | S | 0 |
| 127 | L | 0 |
| 133 | Q | 7 |
| 135 | F | 0 |
| 137 | L | 4 |
| 141 | V | 3 |

TABLE 34-continued

| Highly buried residues of Streptokinase unsuitable for substitution and further modification (SEQ ID NO: 1) | | |
|---|---|---|
| Residue No. in SEQ ID 1 | Amino-acid | Surface accessibility |
| 143 | V | 2 |
| 155 | A | 4 |
| 158 | V | 0 |
| 160 | V | 1 |
| 162 | Y | 1 |
| 169 | L | 8 |
| 196 | S | 0 |
| 203 | A | 0 |
| 207 | L | 1 |
| 222 | S | 4 |
| 224 | V | 1 |
| 226 | H | 2 |
| 245 | V | 7 |
| 266 | N | 4 |
| 268 | D | 0 |
| 270 | I | 5 |
| 272 | E | 1 |
| 274 | Y | 4 |
| 276 | V | 3 |
| 295 | F | 1 |
| 297 | I | 0 |
| 299 | Y | 0 |
| 313 | L | 3 |
| 315 | T | 2 |
| 324 | R | 3 |
| 331 | D | 0 |
| 335 | L | 1 |
| 337 | Y | 2 |
| 340 | L | 1 |
| 342 | A | 6 |
| 365 | I | 1 |
| 367 | V | 0 |
| 369 | M | 0 |

The following articles and disclosures are incorporated by reference herein.

Abuchowski, A., Kazo, G. M., Verhoest, C. R., van Es, T., Kafkewitz, D., Nucci, M. L., Viau, A. T. and Davis, F. F. Cancer Biochem. Biophys. 1984; 7: 175-186.

Adams D S, Griffin L A, Nachajko W R, Reddy V B, Wei C M. A synthetic DNA encoding a modified human urokinase resistant to inhibition by serum plasminogen activator inhibitor. J Biol Chem. 1991; 266(13):8476-8482.

Allen, T. M. Liposomes: opportunities in drug development. Drugs 1997; 54: Suppl. 4, 8-14.

Baker D P, Lin E Y, Lin K, Pellegrini M, Petter R C, Chen L L, Arduini R M, Brickelmaier M, Wen D, Hess D M, Chen L, Grant D, Whitty A, Gill A, Lindner D J, Pepinsky R B. N-terminally PEGylated human interferon-beta-la with improved pharmacokinetic properties and in vivo efficacy in a melanoma angiogenesis model. Bioconjug Chem. 2006; 17(1):179-188.

Banerjee A, Chisti Y, Banerjee U C. Streptokinase—a clinically useful thrombolytic agent. Biotechnol Adv. 2004; 22(4):287-307.

Basu A, Yang K, Wang M, Liu S, Chintala R, Palm T, Zhao H, Peng P, Wu D, Zhang Z, Hua J, Hsieh M C, Zhou J, Petti G, Li X, Janjua A, Mendez M, Liu J, Longley C, Zhang Z, Mehlig M, Borowski V, Viswanathan M, Filpula D. Structure-function engineering of interferon-beta-1b for improving stability, solubility, potency, immunogenicity, and pharmacokinetic properties by site-selective mono-PEGylation. Bioconjug Chem. 2006; 17(3):618-630.

Castellino F. J, A unique enzyme-protein substrate modifier reaction plasmin/streptokinase interaction, Trends Biochem. Sci. 1979, 4:1-5.

Castellino, F. J. Recent advances in the chemistry of the fibrinolytic system. Chem. Rev. 1981; 81: 431-446.

Chaudhary A, Vasudha S, Rajagopal K, Komath S S, Garg N, Yadav M, Mande S C, Sahni G. Function of the central domain of streptokinase in substrate plasminogen docking and processing revealed by site-directed mutagenesis. Protein Sci 1999; 8: 2791-2805.

Collen D, Stump D. C., Gold H. K. Thrombolytic Therapy. Annu Rev Med. 1988; 39:405-423.

Collen D. Coronary Thrombolysis: Streptokinase Or Recombinant Tissue-Type Plasminogen Activator? Ann Intern Med. 1990; 112(7):529-538.

Deutsch D G, Mertz E T. Plasminogen: purification from human plasma by affinity chromatography. Science. 1970; 170(962):1095-1096.

Dhar J, Pande A H, Sundram V, Nanda J S, Mande S C, Sahni G. Involvement of a nine-residue loop of streptokinase in the generation of macromolecular substrate specificity by the activator complex through interaction with substrate kringle domains. J Biol Chem 2002; 277, 13257-13267.

Doherty D H, Rosendahl M S, Smith D J, Hughes J M, Chlipala E A, Cox G N. Site-specific PEGylation of engineered cysteine analogues of recombinant human granulocyte-macrophage colony-stimulating factor. Bioconjug Chem. 2005; 16(5):1291-1298.

Esmon C T, Mather T. Switching serine protease specificity. Nat Struct Biol. 1998; 5(11):933-937.

Fraker P J, Speck J C Jr. Protein and cell membrane iodinations with a sparingly soluble chloroamide, 1,3,4,6-tetrachloro-3a,6a-diphrenylglycoluril. Biochem Biophys Res Comm. 1978; 80(4):849-857.

Francis C W, marder V J. Fibrinolytic therapy for venous thrombosis. Prog Cardiovasc Dis. 1991; 34(3): 193-204.

Grafe S, Ellinger T, Malke H. Structural dissection and functional analysis of the complex promoter of the streptokinase gene from *Streptococcus equisimilis* H46A. Med Microbiol Immunol. 1996; 185(1):11-17.

Hershfield M S, Buckley R H, Greenberg M L, Melton A L, Schiff R, Hatem C, Kurtzberg J, Markert M L, Kobayashi R H, Kobayashi A. L. Treatment of adenosine deaminase deficiency with polyethylene glycol-modified adenosine deaminase. N Engl J Med. 1987; 316(10):589-596.

Huang T T, Malke H, Ferretti J J. Heterogeneity of the streptokinase gene in group A streptococci. Infect Immun. 1989; 57(2):502-506.

ISIS-3: a randomised comparison of streptokinase vs tissue plasminogen activator vs anistreplase and of aspirin plus heparin vs aspirin alone among 41,299 cases of suspected acute myocardial infarction. ISIS-3 (Third International Study of Infarct Survival) Collaborative Group. Lancet. 1992; 339(8796):753-770.

Innis M A, Gelfand D A, Sninsky J J, White T J (1990); PCR. protocols. Academic Press, Inc, San Diego Jackson K W, Tang J. Complete amino acid sequence of streptokinase and its homology with serine proteases. Biochemistry. 1982; 21(26):6620-6625.

Jalihal S, Morris G K. Antistreptokinase titres after intravenous streptokinase. Lancet. 1990; 335(8688):534.

Kabsch W, Sander C. Dictionary of protein secondary structure: pattern recognition of hydrogen-bonded and geometrical features. Biopolymers. 1983; 22(12):2577-2637.

Katre N V, Knauf M J, Laird W J. Chemical modification of recombinant interleukin 2 by polyethylene glycol increases its potency in the murine Meth A sarcoma model. Proc Natl Acad Sci USA. 1987; 84(6):1487-1491.

Katre N V. Immunogenicity of recombinant IL-2 modified by covalent attachment of polyethylene glycol. J Immunol. 1990; 144(1):209-213.

Kurfürst M M. Detection and molecular weight determination of polyethylene glycol-modified hirudin by staining after sodium dodecyl sulfate-polyacrylamide gel electrophoresis. Anal Biochem. 1992; 200(2):244-248.

Laemmli U K. Cleavage of structural proteins during the assembly of the head of bacteriophage T4. Nature. 1970; 227(5259):680-685.

Lähteenmäki K, Kuusela P, Korhonen T K. Bacterial plasminogen activators and receptors. FEMS Microbiol Rev. 2001; 25(5):531-552. Review.

Lee H S, Cross S, Davidson R, Reid T, Jennings K. Raised levels of antistreptokinase antibody and neutralization titres from 4 days to 54 months after administration of streptokinase or anistreplase. Eur Heart J. 1993; 14(1):84-89.

Lijnen H R, Stassen J M, Vanlinthout I, Fukao H, Okada K, Matsuo O, Collen D. Comparative fibrinolytic properties of staphylokinase and streptokinase in animal models of venous thrombosis. Thromb Haemost. 1991; 66(4):468-473.

Lyczak, J. B. & Morrison, S. L. Biological and pharmacokinetic properties of a novel immunoglobulin-CD4 fusion protein. Arch. Virol. 1994; 139, 189-196.

Malke H., Ferretti J J. Streptokinase: cloning, expression, and excretion by *Escherichia coli*. Proc Natl Acad Sci USA. 1984; 81(11):3557-3561.

Malke H, Ferretti J J. Expression in *Escherichia coli* of streptococcal plasmid-determined erythromycin resistance directed by the cat gene promoter of pACYC 184. J Basic Microbiol. 1985; 25(6):393-400.

Malke H. Polymorphism of the streptokinase gene: implications for the pathogenesis of post-streptococcal glomerulonephritis. Zentralbl Bakteriol. 1993; 278(2-3):246-257.

Marder V J. Recombinant streptokinase: opportunity for an improved agent. Blood Coagul Fibrinolysis. 1993; 4(6): 1039-1040.

Mateo C, Lombardero J, Moreno E, Morales A, Bombino G, Coloma J, Wims L, Morrison S L, Peréz R. Removal of amphipathic epitopes from genetically-engineered antibodies: production of modified immmunoglobulins with reduced immunogenicity. Hybridoma. 2000; 19, 436-471.

McGrath K G, Patterson R. Anaphylactic reactivity to streptokinase. JAMA. 1984; 252(10):1314-1317.

McGrath K, Patterson R. Immunology of streptokinase in human subjects. Clin Exp Immunol. 1985; 62(2):421-426.

Meyers F J, Paradise C, Scudder S A, Goodman G, Konrad M. A phase I study including pharmacokinetics of polyethylene glycol conjugated interleukin-2. Clin Pharmacol Ther. 1991; 49(3):307-313.

Monfardini, C. et al. A branched monomethoxypolyethylene glycol for protein modification. Bioconjug. Chem. 1995; 6: 62-69.

Moreadith R W, Collen D. Clinical development of PEGylated recombinant staphylokinase (PEG-Sak) for bolus thrombolytic treatment of patients with acute myocardial infarction. Adv Drug Deliv Rev. 2003; 55(10):1337-45.

Nihalani D, Kumar R, Rajagopal K, Sahni G. Role of the amino-terminal region of streptokinase in the generation of a fully functional plasminogen activator complex probed with synthetic peptides. Protein Sci 1998; 7, 637-648.

Nicolini F A, Nichols W W, Saldeen T G, Khan S, Mehta J L. Adjunctive therapy with low molecular weight heparin with recombinant tissue-type plasminogen activator causes sustained reflow in canine coronary thrombosis. Am Heart J. 1992; 124(2):280-288.

Osborn B L, Olsen H S, Nardelli B, Murray J H, Zhou J X, Garcia A, Moody G, Zaritskaya L S, Sung C. Pharmacokinetic and pharmacodynamic studies of a human serum albumin-interferon-alpha fusion protein in cynomolgus monkeys. J Pharmacol Exp Ther. 2002; 303(2):540-548.

Ouriel K. Comparison of safety and efficacy of the various thrombolytic agents. Rev Cardiovasc Med. 2002; 3 Suppl 2:S17-24. Review.

Pratap J, Kaur J, RajaMohan G, Singh D, Dikshit K L. Role of N-terminal domain of streptokinase in protein transport. Biochem Biophys Res Commun 1996; 227, 303-310.

Rajagopalan S, Gonias S L, Pizzo S V. A nonantigenic covalent streptokinase-polyethylene glycol complex with plasminogen activator function. J Clin Invest. 1985; 75(2):413-9.

Rabijns, A., Hendrik, L., De Bondt, H. L. and De Ranter, C. Three dimensional structure of staphylokinase, a plasminogen activator with therapeutic potential. Nat. Struct. Biol. 1997; 4, 357-360.

Reed G L, Houng A K, Liu L, Parhami-Seren B, Matsueda L H, Wang S, Hedstrom L. A catalytic switch and the conversion of streptokinase to a fibrin-targeted plasminogen activator. Proc Natl Acad Sci USA. 1999; 96(16):8879-83.

Roberts, M. J., Bentley, M. D. & Harris, J. M. Chemistry for peptide and protein PEGylation. Adv. Drug Delivery Rev 2002; 54, 459-476.

Ross A M. New plasminogen activators: a clinical review. Clin Cardiol. 1999; 22(3):165-171. Review.

Sazonova I Y, Robinson B R, Gladysheva I P, Castellino F J, Reed G L. alpha Domain deletion converts streptokinase into a fibrin-dependent plasminogen activator through mechanisms akin to staphylokinase and tissue plasminogen activator. J Biol Chem. 2004; 279(24):24994-5001.

Schweitzer D H, van der Wall E E, Bosker H A, Scheffer E, Macfarlane J D. Serum-sickness-like illness as a complication after streptokinase therapy for acute myocardial infarction. Cardiology. 1991; 78(1):68-71.

Sherry S, Marder V J. Thrombosis, fibrinolysis, and thrombolytic therapy: a perspective. Prog Cardiovasc Dis. 1991; 34(2):89-100.

Shi G Y, Chang B I, Chen S M, Wu D H, Wu H L. Function of streptokinase fragments in plasminogen activation. Biochem J. 1994; 304, 235-241.

Spöttl F, Kaiser R. Rapid detection and quantitation of precipitating streptokinase-antibodies. Thromb Diath Haemorrh. 1974; 32(2-3):608-616.

Studier F W, Moffatt B A. Use of bacteriophage T7 RNA polymerase to direct selective high-level expression of cloned genes. J Mol Biol 1986; 189, 113-130.

Studier F W, Rosenberg A H, Dunn J J, Dubendorff J W. Use of T7 RNA polymerase to direct expression of cloned genes. Methods Enzymol. 1990; 185:60-89.

Sundram V, Nanda J S, Rajagopal K, Dhar J, Chaudhary A, Sahni G. Domain truncation studies reveal that the streptokinase-plasmin activator complex utilizes long range protein-protein interactions with macromolecular substrate to maximize catalytic turnover. J Biol Chem. 2003; 278(33):30569-30577.

Syed, S. et al. Potent antithrombin activity and delayed clearance from the circulation characterize recombinant hirudin genetically fused to albumin. Blood. 1997; 89 (9):3243-3252.

Tillet W S, Garner R L. The fibrinolytic activity of hemolytic streptococci. J Exp Med 1933, 68: 485-488.

Wang X, Lin X, Loy J A, Tang J, Zhang X C. Crystal structure of the catalytic domain of human plasmin complexed with streptokinase. Science. 1998; 281(5383):1662-1665.

Wang X, Tang J, Hunter B, Zhang X C. Crystal structure of streptokinase beta-domain. FEBS Lett. 1999; 459(1):85-89.

Wohl R C, Summaria L, Robbins K C. Kinetics of activation of human plasminogen by different activator species at pH 7.4 and 37 degrees C. J Biol Chem 1980; 255, 2005-2013.

Wu H L, Shi G Y, Bender M L. Preparation and purification of microplasmin. Proc Natl Acad Sci USA. 1987; 84(23): 8292-8295.

Wu X C, Ye R, Duan Y, Wong S L. Engineering of plasmin-resistant forms of streptokinase and their production in *Bacillus subtilis*: streptokinase with longer functional half-life. Appl Environ Microbiol. 1998; 64(3):824-829.

---

SEQUENCE LISTING (496 sequences)

SEQ ID NO: 1 - protein, 414 aa, Streptococcus equisimilis
  MISC_FEATURE (1)..(414): Sequence representing native SK (ATCC 12449)
IAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAYDKDRYTEEEREVYSYLRYTGTPIPDNPNDK

SEQ ID NO: 2 - protein, 383 aa, Artificial Sequence
  Polypeptide construct
  MISC_FEATURE (1)..(383): Sequence representing truncated SK at C-terminal amino acid 1-383
IAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLA

SEQ ID NO: 3 - protein, 399 aa, Artificial Sequence
  Polypeptide construct
  MISC_FEATURE (1)..(399): Sequence having truncated N-terminal SK variant sequence from 16-414 of the native SK sequence, wherein amino acid 1 corresponds to amino acid 16 of  the native SK sequence
SQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAYDKDRYTEEEREVYSYLRYTGTPIPDNPNDK

SEQ ID NO: 4 - protein, 368 aa, Artificial Sequence
  Polypeptide construct
  MISC_FEATURE (1)..(368): Sequence having truncated N and C-terminal SK (16-383) of the native SK sequence, wherein amino acid 1 corresponds to amino acid 16 of  the native SK sequence
SQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLA

SEQ ID NO: 5 - protein, 365 aa, Artificial Sequence
  Polypeptide construct
  MISC_FEATURE (1)..(365): Sequence having N-terminal truncated SK sequence (50-414) of the native SK sequence, wherein amino acid 1 corresponds to amino acid 50 of  the native SK sequence
GKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAYDKDRYTEEEREVYSYLRYTGTPIPDNPNDK

SEQ ID NO: 6 - protein, 324 aa, Artificial Sequence
  Polypeptide construct
  MISC_FEATURE (1)..(324): Sequence having sequence N and C-terminal truncated SK 60-383 of the native SK sequence wherein amino acid 1 corresponds to amino acid 60 of  the native SK sequence
SKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLA

SEQ ID NO: 7 - protein, 414 aa, Artificial Sequence
  Polypeptide construct
  MISC_FEATURE (1)..(414): Sequence having asparagine 90 alanine mutation in SK
IAGPEWLLDRPSVNNSQLVVSVAGTVEGTNQDISLKFFEIDLTSRPAHGGKTEQGLSPKSKPFATDSGAMSHKLEKADLLKAIQEQLIAAVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAYDKDRYTEEEREVYSYLRYTGTPIPDNPNDK

SEQ ID NO: 8 - protein, 414 aa, Artificial Sequence
  Polypeptide construct
  MISC_FEATURE (1)..(414): Sequence having aspartate 227 tyrosine mutation in SK
IAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHYNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAYDKDRYTEEEREVYSYLRYTGTPIPDNPNDK

SEQ ID NO: 9 - protein, 414 aa, Artificial Sequence
  Polypeptide construct
  MISC_FEATURE (1)..(414): Sequence having aspartate 238 alanine mutation in SK
IAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMAQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAYDKDRYTEEEREVYSYLRYTGTPIPDNPNDK

SEQ ID NO: 10 - protein, 414 aa, Artificial Sequence
  Polypeptide construct
  MISC_FEATURE (1)..(414): Sequence having glutamate 240 alanine in SK
IAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQAFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAYDKDRYTEEEREVYSYLRYTGTPIPDNPNDK

SEQ ID NO: 11 - protein, 414 aa, Artificial Sequence
  Polypeptide construct
  MISC_FEATURE (1)..(414): Sequence having arginine 244 alanine mutation in SK
IAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYAVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAYDKDRYTEEEREVYSYLRYTGTPIPDNPNDK

SEQ ID NO: 12 - protein, 414 aa, Artificial Sequence
  Polypeptide construct
  MISC_FEATURE (1)..(414): Sequence having mutation lysine 246 alanine in SK
IAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVANREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAYDKDRYTEEEREVYSYLRYTGTPIPDNPNDK

SEQ ID NO: 13 - protein, 414 aa, Artificial Sequence
  Polypeptide construct
  MISC_FEATURE (1)..(414): Sequence having leucine 260 alanine mutation in SK
IAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGANEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAYDKDRYTEEEREVYSYLRYTGTPIPDNPNDK

SEQ ID NO: 14 - protein, 414 aa, Artificial Sequence
  Polypeptide construct
  MISC_FEATURE (1)..(414): Sequence having aspartate 359 is replaced by argainine in SK
IAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHRDTNRIITVYMGKRPEGENASYHLAYDKDRYTEEEREVYSYLRYTGTPIPDNPNDK

SEQ ID NO: 15 - protein, 414 aa, Artificial Sequence
  Polypeptide construct
  MISC_FEATURE (1)..(414): Sequence having histidine 92 alanine and serine 93 alanine mutation  in SK
IAGPEWLLDRPSVNNSQLVVSVAGTVEGTNQDISLKFFEIDLTSRPAHGGKTEQGLSPKSKPFATDSGAMSHKLEKADLLKAIQEQLIANVAANDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAYDKDRYTEEEREVYSYLRYTGTPIPDNPNDK

SEQ ID NO: 16 - protein, 414 aa, Artificial Sequence
  Polypeptide construct
  MISC_FEATURE (1)..(414): Sequence  having lysine 278 and lysine 279 are replaced by alanine
IAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLAAGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAYDKDRYTEEEREVYSYLRYTGTPIPDNPNDK

SEQ ID NO: 17 - protein, 413 aa, Artificial Sequence
  Polypeptide construct
  MISC_FEATURE (1)..(413): Sequence having asparagine 90 deletion mutation in SK
IAGPEWLLDRPSVNNSQLVVSVAGTVEGTNQDISLKFFEIDLTSRPAHGGKTEQGLSPKSKPFATDSGAMSHKLEKADLLKAIQEQLIAVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAYDKDRYTEEEREVYSYLRYTGTPIPDNPNDK

SEQ ID NO: 18 - protein, 413 aa, Artificial Sequence
  Polypeptide construct
  MISC_FEATURE (1)..(413): Sequence having aspartate 227 deleted mutation in SK
IAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAYDKDRYTEEEREVYSYLRYTGTPIPDNPNDK

SEQ ID NO: 19 - protein, 413 aa, Artificial Sequence
  Polypeptide construct
  MISC_FEATURE (1)..(413): Sequence having aspartate 359 deleted mutation in SK
IAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDTNRIITVYMGKRPEGENASYHLAYDKDRYTEEEREVYSYLRYTGTPIPDNPNDK

SEQ ID NO: 20 - protein, 406 aa, Streptococcus pyogenes
  MISC_FEATURE (1)..(406): Sequence representing a sequence from Streptococcus pyogenes MGAS10270,ABF34818.1
IAGPEWLLDRPSVNNSQLVVSVAGTVEGTNQEISLKFFEIDLTSRPAQGGKTEPGLRPKSKMPYKLEKADLLKAIQEQLIANVHSNDGYFEVIDFASDATITDRNGKVYFADRDDSVTLPTQPVQEFLLSGHVRVRPYRPKAVHNSAERVNVNYEVSFVSETGDLDFTPSLRDRYHLTTLAVGDSLSSQELAAIAQFILSKEHPDYIITKRDSSIVTHDNDIFRTILPMDQEFTYHVKDREQAYGINKKSGQKEKINNTDLISEKYYVLKKGEKPYDPFDRSHLKLFTINYVDVDTNKLLKSEQLLTASERNLDFRDLYDPRDKAKLLYNNLDAFGIMDYTLTGKVEDNHDDTNRIITVYMGKRPEGENASYHLAYDKDRYTEEEREVYSYLRYTGTPIPDNPKDK

SEQ ID NO: 21 - protein, 414 aa, Streptococcus dygalactiae
  MISC_FEATURE (1)..(414): Sequence having sequence from Streptococcus dysgalactiae subsp. Equismilis, AAC60418
IAGPEWLLDRPSVNNSQLVVSVAGTVEGTNQDISLKFFEIDLTSRPAHGGKTEQGLSPKSKPFATDSGAMPHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKTHPGYTIYERDSSIVTHDNDIFRTILPMDQEFTYHVKNREQAYEINKKSGLNEEINNTDLISEKYYVLKKGEKPYDPFDRSHLKLFTIKYVDVNTNELLKSEQLLTASERNLDFRDLYDPRDKAKLLYNNLDAFGIMDYTLTGKVEDNHDDTNRIITVYMGKRPEGENASYHLAYDKDRYTEEEREVYSYLRYTGTPIPDNPNDK

SEQ ID NO: 22 - protein, 531 aa, Artificial Sequence
  Polypeptide construct
  MISC_FEATURE (1)..(531): FUSION POLYPEPTIDE Sequence having hybrid sequence wherein fibrin binding domain is fused at N-terminal of SK
VQAQQIVPIAEKCFDHAAGTSYVVGETWEKPYQGWMMVDCTCLGEGSGRITCTSRNRCNDQDSRTSYRIGDTWSKKDNRGNLLQCICTGNGRGEWKCERHTSVQTTSSGSGPFTDVRIAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAYDKDRYTEEEREVYSYLRYTGTPIPDNPNDK

SEQ ID NO: 23 - protein, 502 aa, Artificial Sequence
  Polypeptide construct
  MISC_FEATURE (1)..(502): FUSION POLYPEPTIDE Sequence having hybrid sequence wherein fibrin binding domain fused at C-terminal of SK (1-383)
IAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAGGGQAQQIVPIAEKCFDHAAGTSYLVGETWEKPYQGWMMVDCTCLGEGSGRITCTSRNRCNDQDTRTSYRIGDTWSKKDNRGNLLQCICTGNGRGEWKCERHTSVQTTSSGSGPFTDVR

SEQ ID NO: 24 - protein, 619 aa, Artificial Sequence
  Polypeptide construct
  MISC_FEATURE (1)..(619): FUSION POLYPEPTIDE Sequence having hybrid sequence wherein fibrin binding domain is fused at N and C-terminal of SK (1-383)
VQAQQIVPIAEKCFDHAAGTSYLVGETWEKPYQGWMMVDCTCLGEGSGRITCTSRNRCNDQDTRTSYRIGDTWSKKDNRGNLLQCICTGNGRGEWKCERHTSVQTTSSGSGPFTDVRIAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDPNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQELSYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAGGGQAQQIVPIAEKCFDHAAGTSYLVGETWEKPYQGWMMVDCTCLGEGSGRITCTSRNRCNDQDTRTSYRIGDTWSKKDNRGNLLQCICTGNGRGEWKCERHTSVQTTSSGSGPFTDVR

SEQ ID NO: 25 - protein, 414 aa, Artificial Sequence
  Polypeptide construct
  MISC_FEATURE (1)..(414): Sequence representing single cysteine substitution mutant made on SEQ ID NO 1, wherein glycine  49 is replaced by cysteine.
IAGPEWLLDRPSVNNSQLVVSVAGTVEGTNQDISLKFFEIDLTSRPAHCGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAYDKDRYTEEEREVYSYLRYTGTPIPDNPNDK

SEQ ID NO: 26 - protein, 414 aa, Artificial Sequence
  Polypeptide construct
  MISC_FEATURE (1)..(414): Sequence representing single cysteine substitution mutant made on SEQ ID NO 1, wherein serine 57 is replaced by cysteine
IAGPEWLLDRPSVNNSQLVVSVAGTVEGTNQDISLKFFEIDLTSRPAHGGKTEQGLCPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAYDKDRYTEEEREVYSYLRYTGTPIPDNPNDK

SEQ ID NO: 27 - protein, 414 aa, Artificial Sequence
  Polypeptide construct
  MISC_FEATURE (1)..(414): Sequence representing single cysteine substitution mutant made on SEQ ID NO 1, wherein Alanine 64 is replaced by cysteine
IAGPEWLLDRPSVNNSQLVVSVAGTVEGTNQDISLKFFEIDLTSRPAHGGKTEQGLSPKSKPFCTDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAYDKDRYTEEEREVYSYLRYTGTPIPDNPNDK

SEQ ID NO: 28 - protein, 414 aa, Artificial Sequence
  Polypeptide construct
  MISC_FEATURE (1)..(414): Sequence representing single cysteine substitution mutant made on SEQ ID NO 1, whereinin isoleucine 88 is replaced by cysteine
IAGPEWLLDRPSVNNSQLVVSVAGTVEGTNQDISLKFFEIDLTSRPAHGGKTEQGLSPKSKPFATDSGAMSHKLEKADLLKAIQEQLCANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAYDKDRYTEEEREVYSYLRYTGTPIPDNPNDK

SEQ ID NO: 29 - protein, 414 aa, Artificial Sequence
  Polypeptide construct
  MISC_FEATURE (1)..(414): Sequence representing single cysteine substitution mutant made on SEQ ID NO 1, whereinin serine 93 is replaced by cysteine
IAGPEWLLDRPSVNNSQLVVSVAGTVEGTNQDISLKFFEIDLTSRPAHGGKTEQGLSPKSKPFATDSGAMSHKLEKADLLKAIQEQLIANVHCNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAYDKDRYTEEEREVYSYLRYTGTPIPDNPNDK

SEQ ID NO: 30 - protein, 414 aa, Artificial Sequence
  Polypeptide construct
  MISC_FEATURE (1)..(414): Sequence representing single cysteine substitution mutant made on SEQ ID NO 1, wherein aspartate 95 is replaced by cysteine
IAGPEWLLDRPSVNNSQLVVSVAGTVEGTNQDISLKFFEIDLTSRPAHGGKTEQGLSPKSKPFATDSGAMSHKLEKADLLKAIQEQLIANVHSNCDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAYDKDRYTEEEREVYSYLRYTGTPIPDNPNDK

SEQ ID NO: 31 - protein, 414 aa, Artificial Sequence
  Polypeptide construct
  MISC_FEATURE (1)..(414): Sequence representing single cysteine substitution mutant made on SEQ ID NO 1, whereinin aspartate 96 is replaced by cysteine
IAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDCYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAYDKDRYTEEEREVYSYLRYTGTPIPDNPNDK

SEQ ID NO: 32 - protein, 414 aa, Artificial Sequence
  Polypeptide construct
  MISC_FEATURE (1)..(414): Sequence representing single cysteine substitution mutant made on SEQ ID NO 1, whereinin aspartate 102 is replaced by cysteine
IAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVICFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAYDKDRYTEEEREVYSYLRYTGTPIPDNPNDK

SEQ ID NO: 33 - protein, 414 aa, Artificial Sequence
  Polypeptide construct
  MISC_FEATURE (1)..(414): Sequence representing single cysteine substitution mutant made on SEQ ID NO 1 whereinin serine 105 is replaced by cysteine
IAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFACDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAYDKDRYTEEEREVYSYLRYTGTPIPDNPNDK

SEQ ID NO: 34 - protein, 414 aa, Artificial Sequence
  Polypeptide construct
  MISC_FEATURE (1)..(414): Sequence representing single cysteine substitution mutant made on SEQ ID NO 1, whereinin aspartate 120 is replaced by cysteine
IAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFACKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAYDKDRYTEEEREVYSYLRYTGTPIPDNPNDK

SEQ ID NO: 35 - protein, 414 aa, Artificial Sequence
  Polypeptide construct
  MISC_FEATURE (1)..(414): Sequence representing single cysteine substitution mutant made on SEQ ID NO 1, whereinin lysine 121 is replaced by cysteine
IAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADCDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAYDKDRYTEEEREVYSYLRYTGTPIPDNPNDK

SEQ ID NO: 36 - protein, 414 aa, Artificial Sequence
  Polypeptide construct
  MISC_FEATURE (1)..(414): Sequence representing single cysteine substitution mutant made on SEQ ID NO 1, whereinin aspartate 122 is replaced by cysteine
IAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKCGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAYDKDRYTEEEREVYSYLRYTGTPIPDNPNDK

SEQ ID NO: 37 - protein, 414 aa, Artificial Sequence
  Polypeptide construct
  MISC_FEATURE (1)..(414): Sequence representing single cysteine substitution mutant made on SEQ ID NO 1, whereinin glutamate 148 is replaced by cysteine
IAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKCKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAYDKDRYTEEEREVYSYLRYTGTPIPDNPNDK

SEQ ID NO: 38 - protein, 414 aa, Artificial Sequence
  Polypeptide construct
  MISC_FEATURE (1)..(414): Sequence representing single cysteine substitution mutant made on SEQ ID NO 1, whereinin lysine  156 is replaced by cysteine
IAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQACSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAYDKDRYTEEEREVYSYLRYTGTPIPDNPNDK

SEQ ID NO: 39 - protein, 414 aa, Artificial Sequence
  Polypeptide construct
  MISC_FEATURE (1)..(414): Sequence representing single cysteine substitution mutant made on SEQ ID NO 1,whereinin aspartate  173 is replaced by cysteine
IAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDCDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAYDKDRYTEEEREVYSYLRYTGTPIPDNPNDK

SEQ ID NO: 40 - protein, 414 aa, Artificial Sequence
  Polypeptide construct
  MISC_FEATURE (1)..(414): Sequence representing single cysteine substitution mutant made on SEQ ID NO 1, whereinin aspartate 174 is replaced by cysteine
IAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDCFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAYDKDRYTEEEREVYSYLRYTGTPIPDNPNDK

SEQ ID NO: 41 - protein, 414 aa, Artificial Sequence
  Polypeptide construct
  MISC_FEATURE (1)..(414): Sequence representing single cysteine substitution mutant made on SEQ ID NO 1, wherein Leucine 179 is replaced by cysteine
IAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGCKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAYDKDRYTEEEREVYSYLRYTGTPIPDNPNDK

SEQ ID NO: 42 - protein, 414 aa, Artificial Sequence
  Polypeptide construct
  MISC_FEATURE (1)..(414): Sequence representing single cysteine substitution mutant made on SEQ ID NO 1,whereinin aspartate 181 is replaced by cysteine
IAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKCTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAYDKDRYTEEEREVYSYLRYTGTPIPDNPNDK

SEQ ID NO: 43 - protein, 414 aa, Artificial Sequence
  Polypeptide construct
  MISC_FEATURE (1)..(414): Sequence representing single cysteine substitution mutant made on SEQ ID NO 1, whereinin serine 205 is replaced by cysteine
IAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQCILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAYDKDRYTEEEREVYSYLRYTGTPIPDNPNDK

SEQ ID NO: 44 - protein, 414 aa, Artificial Sequence
  Polypeptide construct
  MISC_FEATURE (1)..(414): Sequence representing single cysteine substitution mutant made on SEQ ID NO 1, whereinin Alanine 251 is replaced by cysteine
IAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQCYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAYDKDRYTEEEREVYSYLRYTGTPIPDNPNDK

SEQ ID NO: 45 - protein, 414 aa, Artificial Sequence
  Polypeptide construct
  MISC_FEATURE (1)..(414): Sequence representing single cysteine substitution mutant made on SEQ ID NO 1, whereinin isoleucine 254 is replaced by cysteine
IAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRCNKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAYDKDRYTEEEREVYSYLRYTGTPIPDNPNDK

SEQ ID NO: 46 - protein, 414 aa, Artificial Sequence
  Polypeptide construct
  MISC_FEATURE (1)..(414): Sequence representing single cysteine substitution mutant made on SEQ ID NO 1, whereinin asparagine 255 is replaced by cysteine
IAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRICKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAYDKDRYTEEEREVYSYLRYTGTPIPDNPNDK

SEQ ID NO: 47 - protein, 414 aa, Artificial Sequence
  Polypeptide construct
  MISC_FEATURE (1)..(414): Sequence representing single cysteine substitution mutant made on SEQ ID NO 1, whereinin lysine 256 is replaced by cysteine
IAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINCKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAYDKDRYTEEEREVYSYLRYTGTPIPDNPNDK

SEQ ID NO: 48 - protein, 414 aa, Artificial Sequence
  Polypeptide construct
  MISC_FEATURE (1)..(414): Sequence representing single cysteine substitution mutant made on SEQ ID NO 1, whereinin lysine 257 is replaced by cysteine
IAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKCSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAYDKDRYTEEEREVYSYLRYTGTPIPDNPNDK

SEQ ID NO: 49 - protein, 414 aa, Artificial Sequence
  Polypeptide construct
  MISC_FEATURE (1)..(414): Sequence representing single cysteine substitution mutant made on SEQ ID NO 1, whereinin serine 258 is replaced by cysteine
IAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKCGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAYDKDRYTEEEREVYSYLRYTGTPIPDNPNDK

SEQ ID NO: 50 - protein, 414 aa, Artificial Sequence
  Polypeptide construct
  MISC_FEATURE (1)..(414): Sequence representing single cysteine substitution mutant made on SEQ ID NO 1 wherein Leucine 260 is replaced by cystein
IAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGCNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAYDKDRYTEEEREVYSYLRYTGTPIPDNPNDK

SEQ ID NO: 51 - protein, 414 aa, Artificial Sequence
  Polypeptide construct
  MISC_FEATURE (1)..(414): Sequence representing single cysteine substitution mutant made on SEQ ID NO 1,whereinin glutamate 281 is replaced by cysteine
IAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGCKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAYDKDRYTEEEREVYSYLRYTGTPIPDNPNDK

SEQ ID NO: 52 - protein, 414 aa, Artificial Sequence
  Polypeptide construct
  MISC_FEATURE (1)..(414): Sequence representing single cysteine substitution mutant made on SEQ ID NO 1, whereinin lysine 282 is replaced by cysteine
IAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGECPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAYDKDRYTEEEREVYSYLRYTGTPIPDNPNDK

SEQ ID NO: 53 - protein, 414 aa, Artificial Sequence
  Polypeptide construct
  MISC_FEATURE (1)..(414): Sequence representing single cysteine substitution mutant made on SEQ ID NO 1, whereinin phenyalanine 287 is replaced by cysteine
IAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPCDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAYDKDRYTEEEREVYSYLRYTGTPIPDNPNDK

SEQ ID NO: 54 - protein, 414 aa, Artificial Sequence
  Polypeptide construct
  MISC_FEATURE (1)..(414): Sequence representing single cysteine substitution mutant made on SEQ ID NO 1, whereinin Aspartate 303 is replaced by cysteine
IAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVCTNELLKSEQLLTASERNLDFRDLYDPRDKAKLLYNNLDAFGIMDYTLTGKVEDNHDDTNRIITVYMGKRPEGENASYHLAYDKDRYTEEEREVYSYLRYTGTPIPDNPNDK

SEQ ID NO: 55 - protein, 414 aa, Artificial Sequence
  Polypeptide construct
  MISC_FEATURE (1)..(414): Sequence representing single cysteine substitution mutant made on SEQ ID NO 1,whereinin leucine 321 is replaced by cysteine
IAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNCDFRDLYDPRDKAKLLYNNLDAFGIMDYTLTGKVEDNHDDTNRIITVYMGKRPEGENASYHLAYDKDRYTEEEREVYSYLRYTGTPIPDNPNDK

SEQ ID NO: 56 - protein, 414 aa, Artificial Sequence
  Polypeptide construct
  MISC_FEATURE (1)..(414): Sequence representing single cysteine substitution mutant made on SEQ ID NO 1, whereinin leucine 326 is replaced by cysteine
IAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDCYDPRDKAKLLYNNLDAFGIMDYTLTGKVEDNHDDTNRIITVYMGKRPEGENASYHLAYDKDRYTEEEREVYSYLRYTGTPIPDNPNDK

SEQ ID NO: 57 - protein, 414 aa, Artificial Sequence
  Polypeptide construct
  MISC_FEATURE (1)..(414): Sequence representing single cysteine substitution mutant made on SEQ ID NO 1, whereinin alanine 333 is replaced by cysteine
IAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKCKLLYNNLDAFGIMDYTLTGKVEDNHDDTNRIITVYMGKRPEGENASYHLAYDKDRYTEEEREVYSYLRYTGTPIPDNPNDK

SEQ ID NO: 58 - protein, 414 aa, Artificial Sequence
  Polypeptide construct
  MISC_FEATURE (1)..(414): Sequence representing single cysteine substitution mutant made on SEQ ID NO 1, whereinin Aspartate 347 is replaced by cysteine
IAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMCYTLTGKVEDNHDDTNRIITVYMGKRPEGENASYHLAYDKDRYTEEEREVYSYLRYTGTPIPDNPNDK

SEQ ID NO: 59 - protein, 414 aa, Artificial Sequence
  Polypeptide construct
  MISC_FEATURE (1)..(414): Sequence representing single cysteine substitution mutant made on SEQ ID NO 1, whereinin aspartate 360 is replaced by cysteine
IAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDCTNRIITVYMGKRPEGENASYHLAYDKDRYTEEEREVYSYLRYTGTPIPDNPNDK

SEQ ID NO: 60 - protein, 414 aa, Artificial Sequence
  Polypeptide construct
  MISC_FEATURE (1)..(414): Sequence representing single cysteine substitution mutant made on SEQ ID NO 1, whereinin arginine 372 is replaced by cysteine
IAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKCPEGENASYHLAYDKDRYTEEEREVYSYLRYTGTPIPDNPNDK

SEQ ID NO: 61 - protein, 414 aa, Artificial Sequence
  Polypeptide construct
  MISC_FEATURE (1)..(414): Sequence representing double cysteine substitution mutant made on SEQ ID NO 1, whereinin isoleucine 88 and serine 205 are replaced by cysteine
IAGPEWLLDRPSVNNSQLVVSVAGTVEGTNQDISLKFFEIDLTSRPAHGGKTEQGLSPKSKPFATDSGAMSHKLEKADLLKAIQEQLCANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQCILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAYDKDRYTEEEREVYSYLRYTGTPIPDNPNDK

SEQ ID NO: 62 - protein, 414 aa, Artificial Sequence
  Polypeptide construct
  MISC_FEATURE (1)..(414): Sequence representing double cysteine substitution mutant made on SEQ ID NO 1, whereinin serine 93 and asparagines 255 are replaced by cysteine
IAGPEWLLDRPSVNNSQLVVSVAGTVEGTNQDISLKFFEIDLTSRPAHGGKTEQGLSPKSKPFATDSGAMSHKLEKADLLKAIQEQLIANVHCNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRICKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAYDKDRYTEEEREVYSYLRYTGTPIPDNPNDK

SEQ ID NO: 63 - protein, 414 aa, Artificial Sequence
  Polypeptide construct
  MISC_FEATURE (1)..(414): Sequence representing double cysteine substitution mutant made on SEQ ID NO 1, whereinin aspartate 102 and arginine 372 are replaced by cysteine
IAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVICFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKCPEGENASYHLAYDKDRYTEEEREVYSYLRYTGTPIPDNPNDK

SEQ ID NO: 64 - protein, 414 aa, Artificial Sequence
  Polypeptide construct
  MISC_FEATURE (1)..(414): Sequence representing double cysteine substitution mutant made on SEQ ID NO 1, whereinin serine 105 and pheylalanine 287 are replaced by cysteine
IAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFACDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPCDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAYDKDRYTEEEREVYSYLRYTGTPIPDNPNDK

SEQ ID NO: 65 - protein, 414 aa, Artificial Sequence
  Polypeptide construct
  MISC_FEATURE (1)..(414): Sequence representing double cysteine substitution mutant made on SEQ ID NO 1, wherein lysine 121 and aspartate 360 are replaced by cysteine
IAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADCDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDCTNRIITVYMGKRPEGENASYHLAYDKDRYTEEEREVYSYLRYTGTPIPDNPNDK

SEQ ID NO: 66 - protein, 414 aa, Artificial Sequence
  Polypeptide construct
  MISC_FEATURE (1)..(414): Sequence representing triple cysteine substitution mutant made on SEQ ID NO 1, wherein Isoleucine 88, serine 205 and arginine 372 is replaced by cysteine
IAGPEWLLDRPSVNNSQLVVSVAGTVEGTNQDISLKFFEIDLTSRPAHGGKTEQGLSPKSKPFATDSGAMSHKLEKADLLKAIQEQLCANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQCILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKCPEGENASYHLAYDKDRYTEEEREVYSYLRYTGTPIPDNPNDK

SEQ ID NO: 67 - protein, 414 aa, Artificial Sequence
  Polypeptide construct
  MISC_FEATURE (1)..(414): Sequence representing triple cysteine substitution mutant made on SEQ ID NO 1, wherein Serine 93, asparagine 255 and aspartate 347 is replaced by cysteine
IAGPEWLLDRPSVNNSQLVVSVAGTVEGTNQDISLKFFEIDLTSRPAHGGKTEQGLSPKSKPFATDSGAMSHKLEKADLLKAIQEQLIANVHCNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRICKKSGLNEEINNTDLISEKYYVLKKGEKPYDPFDRSHLKLFTIKYVDVDTNELLKSEQLLTASERNLDFRDLYDPRDKAKLLYNNLDAFGIMCYTLTGKVEDNHDDTNRIITVYMGKRPEGENASYHLAYDKDRYTEEEREVYSYLRYTGTPIPDNPNDK

SEQ ID NO: 68 - protein, 414 aa, Artificial Sequence
  Polypeptide construct
  MISC_FEATURE (1)..(414): Sequence representing triple cysteine substitution mutant made on SEQ ID NO 1 wherein Serine 93, asparagine 255 and phenyalanine 287 is replaced by cysteine
IAGPEWLLDRPSVNNSQLVVSVAGTVEGTNQDISLKFFEIDLTSRPAHGGKTEQGLSPKSKPFATDSGAMSHKLEKADLLKAIQEQLIANVHCNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRICKKSGLNEEINNTDLISEKYYVLKKGEKPYDPCDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAYDKDRYTEEEREVYSYLRYTGTPIPDNPNDK

SEQ ID NO: 69 - protein, 414 aa, Artificial Sequence
  Polypeptide construct
  MISC_FEATURE (1)..(414): Sequence representing triple cysteine substitution mutant made on SEQ ID NO 1, wherein aspartate 102,leucine 260 and arginine 372 is replaced by cysteine
IAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVICFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGCNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKCPEGENASYHLAYDKDRYTEEEREVYSYLRYTGTPIPDNPNDK

SEQ ID NO: 70 - protein, 414 aa, Artificial Sequence
  Polypeptide construct
  MISC_FEATURE (1)..(414): Sequence representing triple cysteine substitution mutant made on SEQ ID NO 1,wherein Serine 105, leucine 260 and phenylalanine 287 is replaced by cysteine
IAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFACDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGCNEEINNTDLISEKYYVLKKGEKPYDPCDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAYDKDRYTEEEREVYSYLRYTGTPIPDNPNDK

SEQ ID NO: 71 - protein, 383 aa, Artificial Sequence
  Polypeptide construct
  MISC_FEATURE (1)..(383): Sequence representing single cysteine substitution mutant made on SEQ ID NO 2,wherein glycine 49 is replaced by cystein
IAGPEWLLDRPSVNNSQLVVSVAGTVEGTNQDISLKFFEIDLTSRPAHCGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLA

SEQ ID NO: 72 - protein, 383 aa, Artificial Sequence
  Polypeptide construct
  MISC_FEATURE (1)..(383): Sequence representing single cysteine substitution mutant made on SEQ ID NO 2,wherein serine 57 is replaced by cysteine
IAGPEWLLDRPSVNNSQLVVSVAGTVEGTNQDISLKFFEIDLTSRPAHGGKTEQGLCPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLA

SEQ ID NO: 73 - protein, 383 aa, Artificial Sequence
  Polypeptide construct
  MISC_FEATURE (1)..(383): Sequence representing single cysteine substitution mutant made on SEQ ID NO 2,wherein alanine 64 is replaced by cysteine
IAGPEWLLDRPSVNNSQLVVSVAGTVEGTNQDISLKFFEIDLTSRPAHGGKTEQGLSPKSKPFCTDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLA

SEQ ID NO: 74 - protein, 383 aa, Artificial Sequence
  Polypeptide construct
  MISC_FEATURE (1)..(383): Sequence representing single cysteine substitution mutant made on SEQ ID NO 2,wherein isoleucine 88 is replaced by cysteine
IAGPEWLLDRPSVNNSQLVVSVAGTVEGTNQDISLKFFEIDLTSRPAHGGKTEQGLSPKSKPFATDSGAMSHKLEKADLLKAIQEQLCANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLA

SEQ ID NO: 75 - protein, 383 aa, Artificial Sequence
  Polypeptide construct
  MISC_FEATURE (1)..(383): Sequence representing single cysteine substitution mutant made on SEQ ID NO 2, wherein Serine 93 is replaced by cysteine
IAGPEWLLDRPSVNNSQLVVSVAGTVEGTNQDISLKFFEIDLTSRPAHGGKTEQGLSPKSKPFATDSGAMSHKLEKADLLKAIQEQLIANVHCNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLA

SEQ ID NO: 76 - protein, 383 aa, Artificial Sequence
  Polypeptide construct
  MISC_FEATURE (1)..(383): Sequence representing single cysteine substitution mutant made on SEQ ID NO 2, wherein Aspartate 95 is replaced by cysteine
IAGPEWLLDRPSVNNSQLVVSVAGTVEGTNQDISLKFFEIDLTSRPAHGGKTEQGLSPKSKPFATDSGAMSHKLEKADLLKAIQEQLIANVHSNCDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLA

SEQ ID NO: 77 - protein, 383 aa, Artificial Sequence
  Polypeptide construct
  MISC_FEATURE (1)..(383): Sequence representing single cysteine substitution mutant made on SEQ ID NO 2, wherein Aspartate  96  is replaced by cysteine
IAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDCYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLA

SEQ ID NO: 78 - protein, 383 aa, Artificial Sequence
  Polypeptide construct
  MISC_FEATURE (1)..(383): Sequence representing single cysteine substitution mutant made on SEQ ID NO 2, wherein Aspartate 102 is replaced by cysteine
IAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVICFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLA

SEQ ID NO: 79 - protein, 383 aa, Artificial Sequence
  Polypeptide construct
  MISC_FEATURE (1)..(383): Sequence representing single cysteine substitution mutant made on SEQ ID NO 2, wherein serine 105 is replaced by cysteine
IAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFACDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLA

SEQ ID NO: 80 - protein, 383 aa, Artificial Sequence
  Polypeptide construct
  MISC_FEATURE (1)..(383): Sequence representing single cysteine substitution mutant made on SEQ ID NO 2,wherein Aspartate 120 is replaced by cysteine
IAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFACKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLA

SEQ ID NO: 81 - protein, 383 aa, Artificial Sequence
  Polypeptide construct
  MISC_FEATURE (1)..(383): Sequence representing single cysteine substitution mutant made on SEQ ID NO 2, wherein lysine 121 is replaced by cysteine
IAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADCDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLA

SEQ ID NO: 82 - protein, 383 aa, Artificial Sequence
  Polypeptide construct
  MISC_FEATURE (1)..(383): Sequence representing single cysteine substitution mutant made on SEQ ID NO 2, wherein aspartate  122 is replaced by cysteine
IAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKCGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLA

SEQ ID NO: 83 - protein, 383 aa, Artificial Sequence
  Polypeptide construct
  MISC_FEATURE (1)..(383): Sequence representing single cysteine substitution mutant made on SEQ ID NO 2, wherein glutamate 148 is replaced by cysteine
IAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKCKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLA

SEQ ID NO: 84 - protein, 383 aa, Artificial Sequence
  Polypeptide construct
  MISC_FEATURE (1)..(383): Sequence representing single cysteine substitution mutant made on SEQ ID NO 2, wherein lysine 156 is replaced by cysteine
IAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQACSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLA

SEQ ID NO: 85 - protein, 383 aa, Artificial Sequence
  Polypeptide construct
  MISC_FEATURE (1)..(383): Sequence representing single cysteine substitution mutant made on SEQ ID NO 2, wherein aspartate 173 is replaced by cysteine
IAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDCDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLA

SEQ ID NO: 86 - protein, 383 aa, Artificial Sequence
  Polypeptide construct
  MISC_FEATURE (1)..(383): Sequence representing single cysteine substitution mutant made on SEQ ID NO 2, wherein aspartate 174 is replaced by cysteine
IAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDCFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLA

SEQ ID NO: 87 - protein, 383 aa, Artificial Sequence
  Polypeptide construct
  MISC_FEATURE (1)..(383): Sequence representing single cysteine substitution mutant made on SEQ ID NO 2, wherein leucine 179 is replaced by cysteine
IAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGCKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLA

SEQ ID NO: 88 - protein, 383 aa, Artificial Sequence
  Polypeptide construct
  MISC_FEATURE (1)..(383): Sequence representing single cysteine substitution mutant made on SEQ ID NO 2,wherein aspartate 181 is replaced by cysteine
IAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKCTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLA

SEQ ID NO: 89 - protein, 383 aa, Artificial Sequence
  Polypeptide construct
  MISC_FEATURE (1)..(383): Sequence representing single cysteine substitution mutant made on SEQ ID NO 2, wherein Serine 205 is replaced by cysteine
IAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQCILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLA

SEQ ID NO: 90 - protein, 383 aa, Artificial Sequence
  Polypeptide construct
  MISC_FEATURE (1)..(383): Sequence representing single cysteine substitution mutant made on SEQ ID NO 2, wherein alanine 251 is replaced by cysteine
IAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQCYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLA

SEQ ID NO: 91 - protein, 383 aa, Artificial Sequence
  Polypeptide construct
  MISC_FEATURE (1)..(383): Sequence representing single cysteine substitution mutant made on SEQ ID NO 2,wherein isoleucine 254 is replaced by cysteine
IAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRCNKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLA

SEQ ID NO: 92 - protein, 383 aa, Artificial Sequence
  Polypeptide construct
  MISC_FEATURE (1)..(383): Sequence representing single cysteine substitution mutant made on SEQ ID NO 2, wherein asparagine 255 is replaced by cysteine
IAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRICKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLA

SEQ ID NO: 93 - protein, 383 aa, Artificial Sequence
  Polypeptide construct
  MISC_FEATURE (1)..(383): Sequence representing single cysteine substitution mutant made on SEQ ID NO 2, wherein lysine 256 is replaced by cysteine
IAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINCKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLA

SEQ ID NO: 94 - protein, 383 aa, Artificial Sequence
  Polypeptide construct
  MISC_FEATURE (1)..(383): Sequence representing single cysteine substitution mutant made on SEQ ID NO 2, wherein lysine 257 is replaced by cysteine
IAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKCSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLA

SEQ ID NO: 95 - protein, 383 aa, Artificial Sequence
  Polypeptide construct
  MISC_FEATURE (1)..(383): Sequence representing single cysteine substitution mutant made on SEQ ID NO 2, wherein Serine 258 is replaced by cysteine
IAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKCGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLA

SEQ ID NO: 96 - protein, 383 aa, Artificial Sequence
  Polypeptide construct
  MISC_FEATURE (1)..(383): Sequence representing single cysteine substitution mutant made on SEQ ID NO 2, wherein leucine 260 is replaced by cysteine
IAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGCNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLA

SEQ ID NO: 97 - protein, 383 aa, Artificial Sequence
  Polypeptide construct
  MISC_FEATURE (1)..(383): Sequence representing single cysteine substitution mutant made on SEQ ID NO 2, wherein glutamate 281 is replaced by cysteine
IAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGCKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLA

SEQ ID NO: 98 - protein, 383 aa, Artificial Sequence
  Polypeptide construct
  MISC_FEATURE (1)..(383): Sequence representing single cysteine substitution mutant made on SEQ ID NO 2, wherein lysine 282 is replaced by cysteine
IAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGECPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLA

SEQ ID NO: 99 - protein, 383 aa, Artificial Sequence
  Polypeptide construct
  MISC_FEATURE (1)..(383): Sequence representing single cysteine substitution mutant made on SEQ ID NO 2, wherein phenyalanine 287 is replaced by cysteine
IAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPCDRSHLKLFTIKYVDVDTNELLKSEQLLTASERNLDFRDLYDPRDKAKLLYNNLDAFGIMDYTLTGKVEDNHDDTNRIITVYMGKRPEGENASYHLA

SEQ ID NO: 100 - protein, 383 aa, Artificial Sequence
  Polypeptide construct
  MISC_FEATURE (1)..(383): Sequence representing single cysteine substitution mutant made on SEQ ID NO 2, wherein aspartate 303 is replaced by cysteine
IAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVCTNELLKSEQLLTASERNLDFRDLYDPRDKAKLLYNNLDAFGIMDYTLTGKVEDNHDDTNRIITVYMGKRPEGENASYHLA

SEQ ID NO: 101 - protein, 383 aa, Artificial Sequence
  Polypeptide construct
  MISC_FEATURE (1)..(383): Sequence representing single cysteine substitution mutant made on SEQ ID NO 2, wherein leucine 321 is replaced by cysteine
IAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNCDFRDLYDPRDKAKLLYNNLDAFGIMDYTLTGKVEDNHDDTNRIITVYMGKRPEGENASYHLA

SEQ ID NO: 102 - protein, 383 aa, Artificial Sequence
  Polypeptide construct
  MISC_FEATURE (1)..(383): Sequence representing single cysteine substitution mutant made on SEQ ID NO 2, wherein leucine 326 is replaced by cysteine
IAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDCYDPRDKAKLLYNNLDAFGIMDYTLTGKVEDNHDDTNRIITVYMGKRPEGENASYHLA

SEQ ID NO: 103 - protein, 383 aa, Artificial Sequence
  Polypeptide construct
  MISC_FEATURE (1)..(383): Sequence representing single cysteine substitution mutant made on SEQ ID NO 2, wherein Alanine 333 is replaced by cysteine
IAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKCKLLYNNLDAFGIMDYTLTGKVEDNHDDTNRIITVYMGKRPEGENASYHLA

SEQ ID NO: 104 - protein, 383 aa, Artificial Sequence
  Polypeptide construct
  MISC_FEATURE (1)..(383): Sequence representing single cysteine substitution mutant made on SEQ ID NO 2, wherein aspartate 347 is replaced by cysteine
IAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMCYTLTGKVEDNHDDTNRIITVYMGKRPEGENASYHLA

SEQ ID NO: 105 - protein, 383 aa, Artificial Sequence
  Polypeptide construct
  MISC_FEATURE (1)..(383): Sequence representing single cysteine substitution mutant made on SEQ ID NO 2, wherein aspartate 360 is replaced by cysteine
IAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDCTNRIITVYMGKRPEGENASYHLA

SEQ ID NO: 106 - protein, 383 aa, Artificial Sequence
  Polypeptide construct
  MISC_FEATURE (1)..(383): Sequence representing single cysteine substitution mutant made on SEQ ID NO 2, wherein arginine 372 is replaced by cysteine
IAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKCPEGENASYHLA

SEQ ID NO: 107 - protein, 383 aa, Artificial Sequence
  Polypeptide construct
  MISC_FEATURE (1)..(383): Sequence representing double cysteine substitution mutant made on SEQ ID NO 2, wherein isoleucine 88 and serine 205 are replaced by cysteine
IAGPEWLLDRPSVNNSQLVVSVAGTVEGTNQDISLKFFEIDLTSRPAHGGKTEQGLSPKSKPFATDSGAMSHKLEKADLLKAIQEQLCANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQCILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLA

SEQ ID NO: 108 - protein, 383 aa, Artificial Sequence
  Polypeptide construct
  MISC_FEATURE (1)..(383): Sequence representing double cysteine substitution mutant made on SEQ ID NO 2, wherein serine 93 and asparagine 255 are replaced by cysteine
IAGPEWLLDRPSVNNSQLVVSVAGTVEGTNQDISLKFFEIDLTSRPAHGGKTEQGLSPKSKPFATDSGAMSHKLEKADLLKAIQEQLIANVHCNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRICKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLA

SEQ ID NO: 109 - protein, 383 aa, Artificial Sequence
  Polypeptide construct
  MISC_FEATURE (1)..(383): Sequence representing double cysteine substitution mutant made on SEQ ID NO 2,wherein Aspartate 102 and arginine 372 are replaced by cysteine
IAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVICFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKCPEGENASYHLA

SEQ ID NO: 110 - protein, 383 aa, Artificial Sequence
  Polypeptide construct
  MISC_FEATURE (1)..(383): Sequence representing double cysteine substitution mutant made on SEQ ID NO 2, wherein serine 105 and phenylalanine 287 are replaced by cysteine
IAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFACDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPCDRSHLKLFTIKYVDVDTNELLKSEQLLTASERNLDFRDLYDPRDKAKLLYNNLDAFGIMDYTLTGKVEDNHDDTNRIITVYMGKRPEGENASYHLA

SEQ ID NO: 111 - protein, 383 aa, Artificial Sequence
  Polypeptide construct
  MISC_FEATURE (1)..(383): Sequence representing double cysteine substitution mutant made on SEQ ID NO 2, wherein Lysine  121 and aspartate 360 are replaced by cysteine
IAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADCDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDCTNRIITVYMGKRPEGENASYHLA

SEQ ID NO: 112 - protein, 383 aa, Artificial Sequence
  Polypeptide construct
  MISC_FEATURE (1)..(383): Sequence representing triple cysteine substitution mutant made on SEQ ID NO 2, wherein Isoleucine 88, serine 205 and arginine 372 is replaced by cysteine
IAGPEWLLDRPSVNNSQLVVSVAGTVEGTNQDISLKFFEIDLTSRPAHGGKTEQGLSPKSKPFATDSGAMSHKLEKADLLKAIQEQLCANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQCILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKCPEGENASYHLA

SEQ ID NO: 113 - protein, 383 aa, Artificial Sequence
  Polypeptide construct
  MISC_FEATURE (1)..(383): Sequence representing triple cysteine substitution mutant made on SEQ ID NO 2, wherein Serine 93, asparagine 255 and aspartate 347 is replaced by cysteine
IAGPEWLLDRPSVNNSQLVVSVAGTVEGTNQDISLKFFEIDLTSRPAHGGKTEQGLSPKSKPFATDSGAMSHKLEKADLLKAIQEQLIANVHCNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRICKKSGLNEEINNTDLISEKYYVLKKGEKPYDPFDRSHLKLFTIKYVDVDTNELLKSEQLLTASERNLDFRDLYDPRDKAKLLYNNLDAFGIMCYTLTGKVEDNHDDTNRIITVYMGKRPEGENASYHLA

SEQ ID NO: 114 - protein, 383 aa, Artificial Sequence
  Polypeptide construct
  MISC_FEATURE (1)..(383): Sequence representing triple cysteine substitution mutant made on SEQ ID NO 2, wherein Serine 93, asparagine 255 and phenyalanine 287 is replaced by cysteine
IAGPEWLLDRPSVNNSQLVVSVAGTVEGTNQDISLKFFEIDLTSRPAHGGKTEQGLSPKSKPFATDSGAMSHKLEKADLLKAIQEQLIANVHCNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRICKKSGLNEEINNTDLISEKYYVLKKGEKPYDPCDRSHLKLFTIKYVDVDTNELLKSEQLLTASERNLDFRDLYDPRDKAKLLYNNLDAFGIMDYTLTGKVEDNHDDTNRIITVYMGKRPEGENASYHLA

SEQ ID NO: 115 - protein, 383 aa, Artificial Sequence
  Polypeptide construct
  MISC_FEATURE (1)..(383): Sequence representing triple cysteine substitution mutant made on SEQ ID NO 2,wherein Aspartate 102, leucine 260 and arganine 372 is replaced by cysteine
IAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVICFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGCNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKCPEGENASYHLA

SEQ ID NO: 116 - protein, 383 aa, Artificial Sequence
  Polypeptide construct
  MISC_FEATURE (1)..(383): Sequence representing triple cysteine substitution mutant made on SEQ ID NO 2, wherein Serine 105, leu 260 and phenylalanine 287 is replaced by cysteine
IAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFACDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGCNEEINNTDLISEKYYVLKKGEKPYDPCDRSHLKLFTIKYVDVDTNELLKSEQLLTASERNLDFRDLYDPRDKAKLLYNNLDAFGIMDYTLTGKVEDNHDDTNRIITVYMGKRPEGENASYHLA

SEQ ID NO: 117 - protein, 399 aa, Artificial Sequence
  Polypeptide construct
  MISC_FEATURE (1)..(399): Sequence representing single cysteine substitution mutant made on SEQ ID NO 3, wherein glycine 34 of SEQ ID NO 3 is replaced by cysteine
SQLVVSVAGTVEGTNQDISLKFFEIDLTSRPAHCGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAYDKDRYTEEEREVYSYLRYTGTPIPDNPNDK

SEQ ID NO: 118 - protein, 399 aa, Artificial Sequence
  Polypeptide construct
  MISC_FEATURE (1)..(399): Sequence representing single cysteine substitution mutant made on SEQ ID NO 3, wherein Serine 57 corresponding to native SK sequence is replaced by cysteine
SQLVVSVAGTVEGTNQDISLKFFEIDLTSRPAHGGKTEQGLCPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAYDKDRYTEEEREVYSYLRYTGTPIPDNPNDK

SEQ ID NO: 119 - protein, 399 aa, Artificial Sequence
  Polypeptide construct
  MISC_FEATURE (1)..(399): Sequence representing single cysteine substitution mutant made on SEQ ID NO 3, wherein alanine 64 corresponding to native SK sequence is replaced by cysteine
SQLVVSVAGTVEGTNQDISLKFFEIDLTSRPAHGGKTEQGLSPKSKPFCTDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAYDKDRYTEEEREVYSYLRYTGTPIPDNPNDK

SEQ ID NO: 120 - protein, 399 aa, Artificial Sequence
  Polypeptide construct
  MISC_FEATURE (1)..(399): Sequence representing single cysteine substitution mutant made on SEQ ID NO 3, wherein Isoleucine 88 corresponding to native SK sequence is replaced by cysteine
SQLVVSVAGTVEGTNQDISLKFFEIDLTSRPAHGGKTEQGLSPKSKPFATDSGAMSHKLEKADLLKAIQEQLCANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAYDKDRYTEEEREVYSYLRYTGTPIPDNPNDK

SEQ ID NO: 121 - protein, 399 aa, Artificial Sequence
  Polypeptide construct
  MISC_FEATURE (1)..(399): Sequence representing single cysteine substitution mutant made on SEQ ID NO 3, wherein serine 93 corresponding to native SK sequence is replaced by cysteine
SQLVVSVAGTVEGTNQDISLKFFEIDLTSRPAHGGKTEQGLSPKSKPFATDSGAMSHKLEKADLLKAIQEQLIANVHCNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAYDKDRYTEEEREVYSYLRYTGTPIPDNPNDK

SEQ ID NO: 122 - protein, 399 aa, Artificial Sequence
  Polypeptide construct
  MISC_FEATURE (1)..(399): Sequence representing single cysteine substitution mutant made on SEQ ID NO 3, wherein aspartate 95 corresponding to native SK sequence is replaced by cysteine
SQLVVSVAGTVEGTNQDISLKFFEIDLTSRPAHGGKTEQGLSPKSKPFATDSGAMSHKLEKADLLKAIQEQLIANVHSNCDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAYDKDRYTEEEREVYSYLRYTGTPIPDNPNDK

SEQ ID NO: 123 - protein, 399 aa, Artificial Sequence
  Polypeptide construct
  MISC_FEATURE (1)..(399): Sequence representing single cysteine substitution mutant made on SEQ ID NO 3, wherein aspartate 96 corresponding to native SK sequence is replaced by cysteine
SQLVVSVAGTVEGTNQDISLKFFEIDLTSRPAHGGKTEQGLSPKSKPFATDSGAMSHKLEKADLLKAIQEQLIANVHSNDCYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAYDKDRYTEEEREVYSYLRYTGTPIPDNPNDK

SEQ ID NO: 124 - protein, 399 aa, Artificial Sequence
  Polypeptide construct
  MISC_FEATURE (1)..(399): Sequence representing single cysteine substitution mutant made on SEQ ID NO 3, wherein aspartate 102 corresponding to native SK sequence is replaced by cysteine
SQLVVSVAGTVEGTNQDISLKFFEIDLTSRPAHGGKTEQGLSPKSKPFATDSGAMSHKLEKADLLKAIQEQLIANVHSNDDYFEVICFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAYDKDRYTEEEREVYSYLRYTGTPIPDNPNDK

SEQ ID NO: 125 - protein, 399 aa, Artificial Sequence
  Polypeptide construct
  MISC_FEATURE (1)..(399): Sequence representing single cysteine substitution mutant made on SEQ ID NO 3, wherein serine 105 corresponding to native SK sequence is replaced by cysteine
SQLVVSVAGTVEGTNQDISLKFFEIDLTSRPAHGGKTEQGLSPKSKPFATDSGAMSHKLEKADLLKAIQEQLIANVHSNDDYFEVIDFACDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAYDKDRYTEEEREVYSYLRYTGTPIPDNPNDK

SEQ ID NO: 126 - protein, 399 aa, Artificial Sequence
  Polypeptide construct
  MISC_FEATURE (1)..(399): Sequence representing single cysteine substitution mutant made on SEQ ID NO 3, wherein Aspartate 120 corresponding to native SK sequence is replaced by cysteine
SQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFACKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAYDKDRYTEEEREVYSYLRYTGTPIPDNPNDK

SEQ ID NO: 127 - protein, 399 aa, Artificial Sequence
  Polypeptide construct
  MISC_FEATURE (1)..(399): Sequence representing single cysteine substitution mutant made on SEQ ID NO 3, wherein lysine 121 corresponding to native SK sequence is replaced by cysteine
SQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADCDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAYDKDRYTEEEREVYSYLRYTGTPIPDNPNDK

SEQ ID NO: 128 - protein, 399 aa, Artificial Sequence
  Polypeptide construct
  MISC_FEATURE (1)..(399): Sequence representing single cysteine substitution mutant made on SEQ ID NO 3,wherein aspartate 122 corresponding to native SK sequence is replaced by cysteine
SQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKCGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAYDKDRYTEEEREVYSYLRYTGTPIPDNPNDK

SEQ ID NO: 129 - protein, 399 aa, Artificial Sequence
  Polypeptide construct
  MISC_FEATURE (1)..(399): Sequence representing single cysteine substitution mutant made on SEQ ID NO 3, wherein glutamate 148 corresponding to native SK sequence is replaced by cysteine
SQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKCKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAYDKDRYTEEEREVYSYLRYTGTPIPDNPNDK

SEQ ID NO: 130 - protein, 399 aa, Artificial Sequence
  Polypeptide construct
  MISC_FEATURE (1)..(399): Sequence representing single cysteine substitution mutant made on SEQ ID NO 3, wherein lysine 156 corresponding to native SK sequence is replaced by cysteine
SQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQACSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAYDKDRYTEEEREVYSYLRYTGTPIPDNPNDK

SEQ ID NO: 131 - protein, 399 aa, Artificial Sequence
  Polypeptide construct
  MISC_FEATURE (1)..(399): Sequence representing single cysteine substitution mutant made on SEQ ID NO 3, wherein aspartate 173 corresponding to native SK sequence is replaced by cysteine
SQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDCDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAYDKDRYTEEEREVYSYLRYTGTPIPDNPNDK

SEQ ID NO: 132 - protein, 399 aa, Artificial Sequence
  Polypeptide construct
  MISC_FEATURE (1)..(399): Sequence representing single cysteine substitution mutant made on SEQ ID NO 3, wherein aspartate 174 corresponding to native SK sequence is replaced by cysteine
SQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDCFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAYDKDRYTEEEREVYSYLRYTGTPIPDNPNDK

SEQ ID NO: 133 - protein, 399 aa, Artificial Sequence
  Polypeptide construct
  MISC_FEATURE (1)..(399): Sequence representing single cysteine substitution mutant made on SEQ ID NO 3,wherein leucine 179 corresponding to native SK sequence is replaced by cysteine
SQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGCKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAYDKDRYTEEEREVYSYLRYTGTPIPDNPNDK

SEQ ID NO: 134 - protein, 399 aa, Artificial Sequence
  Polypeptide construct
  MISC_FEATURE (1)..(399): Sequence representing single cysteine substitution mutant made on SEQ ID NO 3, wherein aspartate 181 corresponding to native SK sequence is replaced by cysteine
SQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKCTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAYDKDRYTEEEREVYSYLRYTGTPIPDNPNDK

SEQ ID NO: 135 - protein, 399 aa, Artificial Sequence
  Polypeptide construct
  MISC_FEATURE (1)..(399): Sequence representing single cysteine substitution mutant made on SEQ ID NO 3, wherein serine 205 corresponding to native SK sequence is replaced by cysteine
SQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQCILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAYDKDRYTEEEREVYSYLRYTGTPIPDNPNDK

SEQ ID NO: 136 - protein, 399 aa, Artificial Sequence
  Polypeptide construct
  MISC_FEATURE (1)..(399): Sequence representing single cysteine substitution mutant made on SEQ ID NO 3, wherein alanine 251 corresponding to native SK sequence is replaced by cysteine
SQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQCYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAYDKDRYTEEEREVYSYLRYTGTPIPDNPNDK

SEQ ID NO: 137 - protein, 399 aa, Artificial Sequence
  Polypeptide construct
  MISC_FEATURE (1)..(399): Sequence representing single cysteine substitution mutant made on SEQ ID NO 3, wherein isoleucine 254 corresponding to native SK sequence is replaced by cysteine
SQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRCNKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAYDKDRYTEEEREVYSYLRYTGTPIPDNPNDK

SEQ ID NO: 138 - protein, 399 aa, Artificial Sequence
  Polypeptide construct
  MISC_FEATURE (1)..(399): Sequence representing single cysteine substitution mutant made on SEQ ID NO 3, wherein asparagine 255 corresponding to native SK sequence is replaced by cysteine
SQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRICKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAYDKDRYTEEEREVYSYLRYTGTPIPDNPNDK

SEQ ID NO: 139 - protein, 399 aa, Artificial Sequence
  Polypeptide construct
  MISC_FEATURE (1)..(399): Sequence representing single cysteine substitution mutant made on SEQ ID NO 3, wherein lysine 256 corresponding to native SK sequence is replaced by cysteine
SQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINCKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAYDKDRYTEEEREVYSYLRYTGTPIPDNPNDK

SEQ ID NO: 140 - protein, 399 aa, Artificial Sequence
  Polypeptide construct
  MISC_FEATURE (1)..(399): Sequence representing single cysteine substitution mutant made on SEQ ID NO 3, wherein lysine 257 corresponding to native SK sequence is replaced by cysteine
SQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKCSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAYDKDRYTEEEREVYSYLRYTGTPIPDNPNDK

SEQ ID NO: 141 - protein, 399 aa, Artificial Sequence
  Polypeptide construct
  MISC_FEATURE (1)..(399): Sequence representing single cysteine substitution mutant made on SEQ ID NO 3, wherein serine 258 corresponding to native SK sequence is replaced by cysteine
SQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKCGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAYDKDRYTEEEREVYSYLRYTGTPIPDNPNDK

SEQ ID NO: 142 - protein, 399 aa, Artificial Sequence
  Polypeptide construct
  MISC_FEATURE (1)..(399): Sequence representing single cysteine substitution mutant made on SEQ ID NO 3, wherein leucine 260 corresponding to native SK sequence is replaced by cysteine
SQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGCNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAYDKDRYTEEEREVYSYLRYTGTPIPDNPNDK

SEQ ID NO: 143 - protein, 399 aa, Artificial Sequence
  Polypeptide construct
  MISC_FEATURE (1)..(399): Sequence representing single cysteine substitution mutant made on SEQ ID NO 3,wherein glutamate 281 corresponding to native SK sequence is replaced by cysteine
SQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGCKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAYDKDRYTEEEREVYSYLRYTGTPIPDNPNDK

SEQ ID NO: 144 - protein, 399 aa, Artificial Sequence
  Polypeptide construct
  MISC_FEATURE (1)..(399): Sequence representing single cysteine substitution mutant made on SEQ ID NO 3,wherein lysine 282 corresponding to native SK sequence is replaced by cysteine
SQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGECPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAYDKDRYTEEEREVYSYLRYTGTPIPDNPNDK

SEQ ID NO: 145 - protein, 399 aa, Artificial Sequence
  Polypeptide construct
  MISC_FEATURE (1)..(399): Sequence representing single cysteine substitution mutant made on SEQ ID NO 3, wherein phenyalanine 287 corresponding to native SK sequence is replaced by cysteine
SQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPCDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAYDKDRYTEEEREVYSYLRYTGTPIPDNPNDK

SEQ ID NO: 146 - protein, 399 aa, Artificial Sequence
  Polypeptide construct
  MISC_FEATURE (1)..(399): Sequence representing single cysteine substitution mutant made on SEQ ID NO 3, wherein aspartate 303 corresponding to native SK sequence is replaced by cysteine
SQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVCTNELLKSEQLLTASERNLDFRDLYDPRDKAKLLYNNLDAFGIMDYTLTGKVEDNHDDTNRIITVYMGKRPEGENASYHLAYDKDRYTEEEREVYSYLRYTGTPIPDNPNDK

SEQ ID NO: 147 - protein, 399 aa, Artificial Sequence
  Polypeptide construct
  MISC_FEATURE (1)..(399): Sequence representing single cysteine substitution mutant made on SEQ ID NO 3, wherein leucine 321 corresponding to native SK sequence is replaced by cysteine
SQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNCDFRDLYDPRDKAKLLYNNLDAFGIMDYTLTGKVEDNHDDTNRIITVYMGKRPEGENASYHLAYDKDRYTEEEREVYSYLRYTGTPIPDNPNDK

SEQ ID NO: 148 - protein, 399 aa, Artificial Sequence
  Polypeptide construct
  MISC_FEATURE (1)..(399): Sequence representing single cysteine substitution mutant made on SEQ ID NO 3, wherein leucine 326 corresponding to native SK sequence is replaced by cysteine
SQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDCYDPRDKAKLLYNNLDAFGIMDYTLTGKVEDNHDDTNRIITVYMGKRPEGENASYHLAYDKDRYTEEEREVYSYLRYTGTPIPDNPNDK

SEQ ID NO: 149 - protein, 399 aa, Artificial Sequence
  Polypeptide construct
  MISC_FEATURE (1)..(399): Sequence representing single cysteine substitution mutant made on SEQ ID NO 3,wherein alanine 333 corresponding to native SK sequence is replaced by cysteine
SQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKCKLLYNNLDAFGIMDYTLTGKVEDNHDDTNRIITVYMGKRPEGENASYHLAYDKDRYTEEEREVYSYLRYTGTPIPDNPNDK

SEQ ID NO: 150 - protein, 399 aa, Artificial Sequence
  Polypeptide construct
  MISC_FEATURE (1)..(399): Sequence representing single cysteine substitution mutant made on SEQ ID NO 3, wherein aspartate 347 corresponding to native SK sequence is replaced by cysteine
SQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMCYTLTGKVEDNHDDTNRIITVYMGKRPEGENASYHLAYDKDRYTEEEREVYSYLRYTGTPIPDNPNDK

SEQ ID NO: 151 - protein, 399 aa, Artificial Sequence
  Polypeptide construct
  MISC_FEATURE (1)..(399): Sequence representing single cysteine substitution mutant made on SEQ ID NO 3,wherein aspartate 360 corresponding to native SK sequence is replaced by cysteine
SQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDCTNRIITVYMGKRPEGENASYHLAYDKDRYTEEEREVYSYLRYTGTPIPDNPNDK

SEQ ID NO: 152 - protein, 399 aa, Artificial Sequence
  Polypeptide construct
  MISC_FEATURE (1)..(399): Sequence representing single cysteine substitution mutant made on SEQ ID NO 3, wherein arginine 372 corresponding to native SK sequence is replaced by cysteine
SQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKCPEGENASYHLAYDKDRYTEEEREVYSYLRYTGTPIPDNPNDK

SEQ ID NO: 153 - protein, 399 aa, Artificial Sequence
  Polypeptide construct
  MISC_FEATURE (1)..(399): Sequence representing double cysteine substitution mutant made on SEQ ID NO 3, wherein isoleucine 88 and serine 205 corresponding to native SK sequence are replaced by cysteine
SQLVVSVAGTVEGTNQDISLKFFEIDLTSRPAHGGKTEQGLSPKSKPFATDSGAMSHKLEKADLLKAIQEQLCANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQCILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAYDKDRYTEEEREVYSYLRYTGTPIPDNPNDK

SEQ ID NO: 154 - protein, 399 aa, Artificial Sequence
  Polypeptide construct
  MISC_FEATURE (1)..(399): Sequence representing double cysteine substitution mutant made on SEQ ID NO 3, wherein Serine 93 and asparagine 255 corresponding to native SK sequence are replaced by cysteine
SQLVVSVAGTVEGTNQDISLKFFEIDLTSRPAHGGKTEQGLSPKSKPFATDSGAMSHKLEKADLLKAIQEQLIANVHCNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRICKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAYDKDRYTEEEREVYSYLRYTGTPIPDNPNDK

SEQ ID NO: 155 - protein, 399 aa, Artificial Sequence
  Polypeptide construct
  MISC_FEATURE (1)..(399): Sequence representing double cysteine substitution mutant made on SEQ ID NO 3, wherein aspartate 102 and arginine 372 corresponding to native SK sequence are replaced by cysteine
SQLVVSVAGTVEGTNQDISLKFFEIDLTSRPAHGGKTEQGLSPKSKPFATDSGAMSHKLEKADLLKAIQEQLIANVHSNDDYFEVICFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKCPEGENASYHLAYDKDRYTEEEREVYSYLRYTGTPIPDNPNDK

SEQ ID NO: 156 - protein, 399 aa, Artificial Sequence
  Polypeptide construct
  MISC_FEATURE (1)..(399): Sequence representing double cysteine substitution mutant made on SEQ ID NO 3, wherein serine 105 and phenylalanine 287 corresponding to native SK sequence are replaced by cysteine
SQLVVSVAGTVEGTNQDISLKFFEIDLTSRPAHGGKTEQGLSPKSKPFATDSGAMSHKLEKADLLKAIQEQLIANVHSNDDYFEVIDFACDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPCDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAYDKDRYTEEEREVYSYLRYTGTPIPDNPNDK

SEQ ID NO: 157 - protein, 399 aa, Artificial Sequence
  Polypeptide construct
  MISC_FEATURE (1)..(399): Sequence representing double cysteine substitution mutant made on SEQ ID NO 3,wherein lysine 121 and aspartate 360 corresponding to native SK sequence are replaced by cysteine
SQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADCDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDCTNRIITVYMGKRPEGENASYHLAYDKDRYTEEEREVYSYLRYTGTPIPDNPNDK

SEQ ID NO: 158 - protein, 399 aa, Artificial Sequence
  Polypeptide construct
  MISC_FEATURE (1)..(399): Sequence representing triple cysteine substitution mutant made on SEQ ID NO 3,wherein isoleucine 88, serine 205 and arginine 372 corresponding to native SK sequence are replaced by cysteine
SQLVVSVAGTVEGTNQDISLKFFEIDLTSRPAHGGKTEQGLSPKSKPFATDSGAMSHKLEKADLLKAIQEQLCANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQCILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKCPEGENASYHLAYDKDRYTEEEREVYSYLRYTGTPIPDNPNDK

SEQ ID NO: 159 - protein, 399 aa, Artificial Sequence
  Polypeptide construct
  MISC_FEATURE (1)..(399): Sequence representing triple cysteine substitution mutant made on SEQ ID NO 3, wherein serine 93, asparagine 255 and aspartate 347 corresponding to native SK sequence are replaced by cysteine
SQLVVSVAGTVEGTNQDISLKFFEIDLTSRPAHGGKTEQGLSPKSKPFATDSGAMSHKLEKADLLKAIQEQLIANVHCNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRICKKSGLNEEINNTDLISEKYYVLKKGEKPYDPFDRSHLKLFTIKYVDVDTNELLKSEQLLTASERNLDFRDLYDPRDKAKLLYNNLDAFGIMCYTLTGKVEDNHDDTNRIITVYMGKRPEGENASYHLAYDKDRYTEEEREVYSYLRYTGTPIPDNPNDK

SEQ ID NO: 160 - protein, 399 aa, Artificial Sequence
  Polypeptide construct
  MISC_FEATURE (1)..(399): Sequence representing triple cysteine substitution mutant made on SEQ ID NO 3, wherein serine 93, asparagine 255 and phenyalanine 287 corresponding to native SK sequence are replaced by cysteine
SQLVVSVAGTVEGTNQDISLKFFEIDLTSRPAHGGKTEQGLSPKSKPFATDSGAMSHKLEKADLLKAIQEQLIANVHCNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRICKKSGLNEEINNTDLISEKYYVLKKGEKPYDPCDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAYDKDRYTEEEREVYSYLRYTGTPIPDNPNDK

SEQ ID NO: 161 - protein, 399 aa, Artificial Sequence
  Polypeptide construct
  MISC_FEATURE (1)..(399): Sequence representing triple cysteine substitution mutant made on SEQ ID NO 3, wherein aspartate 102, leucine 260 and arginine 372 corresponding to native SK sequence are replaced by cysteine
SQLVVSVAGTVEGTNQDISLKFFEIDLTSRPAHGGKTEQGLSPKSKPFATDSGAMSHKLEKADLLKAIQEQLIANVHSNDDYFEVICFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGCNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKCPEGENASYHLAYDKDRYTEEEREVYSYLRYTGTPIPDNPNDK

SEQ ID NO: 162 - protein, 399 aa, Artificial Sequence
  Polypeptide construct
  MISC_FEATURE (1)..(399): Sequence representing triple cysteine substitution mutant made on SEQ ID NO 3, wherein serine 105, leucine 260 and phenylalanine 287 corresponding to native SK sequence are replaced by cysteine
SQLVVSVAGTVEGTNQDISLKFFEIDLTSRPAHGGKTEQGLSPKSKPFATDSGAMSHKLEKADLLKAIQEQLIANVHSNDDYFEVIDFACDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGCNEEINNTDLISEKYYVLKKGEKPYDPCDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAYDKDRYTEEEREVYSYLRYTGTPIPDNPNDK

SEQ ID NO: 163 - protein, 368 aa, Artificial Sequence
  Polypeptide construct
  MISC_FEATURE (1)..(368): Sequence representing single cysteine substitution mutant made on SEQ ID NO 4, wherein glycine 49 corresponding to native SK sequence is replaced by cysteine
SQLVVSVAGTVEGTNQDISLKFFEIDLTSRPAHCGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLA

SEQ ID NO: 164 - protein, 368 aa, Artificial Sequence
  Polypeptide construct
  MISC_FEATURE (1)..(368): Sequence representing single cysteine substitution mutant made on SEQ ID NO 4, wherein serine 57 corresponding to native SK sequence is replaced by cysteine
SQLVVSVAGTVEGTNQDISLKFFEIDLTSRPAHGGKTEQGLCPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLA

SEQ ID NO: 165 - protein, 368 aa, Artificial Sequence
  Polypeptide construct
  MISC_FEATURE (1)..(368): Sequence representing single cysteine substitution mutant made on SEQ ID NO 4, wherein alanine 64 corresponding to native SK sequence is replaced by cysteine
SQLVVSVAGTVEGTNQDISLKFFEIDLTSRPAHGGKTEQGLSPKSKPFCTDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLA

SEQ ID NO: 166 - protein, 368 aa, Artificial Sequence
  Polypeptide construct
  MISC_FEATURE (1)..(368): Sequence representing single cysteine substitution mutant made on SEQ ID NO 4, wherein soleucine 88 corresponding to native SK sequence is replaced by cysteine
SQLVVSVAGTVEGTNQDISLKFFEIDLTSRPAHGGKTEQGLSPKSKPFATDSGAMSHKLEKADLLKAIQEQLCANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLA

SEQ ID NO: 167 - protein, 368 aa, Artificial Sequence
  Polypeptide construct
  MISC_FEATURE (1)..(368): Sequence representing single cysteine substitution mutant made on SEQ ID NO 4, wherein serine 93 corresponding to native SK sequence is replaced by cysteine
SQLVVSVAGTVEGTNQDISLKFFEIDLTSRPAHGGKTEQGLSPKSKPFATDSGAMSHKLEKADLLKAIQEQLIANVHCNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLA

SEQ ID NO: 168 - protein, 368 aa, Artificial Sequence
  Polypeptide construct
  MISC_FEATURE (1)..(368): Sequence representing single cysteine substitution mutant made on SEQ ID NO 4, wherein aspartate 95 corresponding to native SK sequence is replaced by cysteine
SQLVVSVAGTVEGTNQDISLKFFEIDLTSRPAHGGKTEQGLSPKSKPFATDSGAMSHKLEKADLLKAIQEQLIANVHSNCDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLA

SEQ ID NO: 169 - protein, 368 aa, Artificial Sequence
  Polypeptide construct
  MISC_FEATURE (1)..(368): Sequence representing single cysteine substitution mutant made on SEQ ID NO 4, wherein aspartate 96 corresponding to native SK sequence is replaced by cysteine
SQLVVSVAGTVEGTNQDISLKFFEIDLTSRPAHGGKTEQGLSPKSKPFATDSGAMSHKLEKADLLKAIQEQLIANVHSNDCYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLA

SEQ ID NO: 170 - protein, 368 aa, Artificial Sequence
  Polypeptide construct
  MISC_FEATURE (1)..(368): Sequence representing single cysteine substitution mutant made on SEQ ID NO 4, wherein aspartate 102 corresponding to native SK sequence is replaced by cysteine
SQLVVSVAGTVEGTNQDISLKFFEIDLTSRPAHGGKTEQGLSPKSKPFATDSGAMSHKLEKADLLKAIQEQLIANVHSNDDYFEVICFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLA

SEQ ID NO: 171 - protein, 368 aa, Artificial Sequence
  Polypeptide construct
  MISC_FEATURE (1)..(368): Sequence representing single cysteine substitution mutant made on SEQ ID NO 4, wherein serine 105 corresponding to native SK sequence is replaced by cysteine
SQLVVSVAGTVEGTNQDISLKFFEIDLTSRPAHGGKTEQGLSPKSKPFATDSGAMSHKLEKADLLKAIQEQLIANVHSNDDYFEVIDFACDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLA

SEQ ID NO: 172 - protein, 368 aa, Artificial Sequence
  Polypeptide construct
  MISC_FEATURE (1)..(368): Sequence representing single cysteine substitution mutant made on SEQ ID NO 4, wherein aspartate 120 corresponding to native SK sequence is replaced by cysteine
SQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFACKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLA

SEQ ID NO: 173 - protein, 368 aa, Artificial Sequence
  Polypeptide construct
  MISC_FEATURE (1)..(368): Sequence representing single cysteine substitution mutant made on SEQ ID NO 4, wherein lysine 121 corresponding to native SK sequence is replaced by cysteine
SQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADCDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLA

SEQ ID NO: 174 - protein, 368 aa, Artificial Sequence
  Polypeptide construct
  MISC_FEATURE (1)..(368): Sequence representing single cysteine substitution mutant made on SEQ ID NO 4, wherein aspartate 122 corresponding to native SK sequence is replaced by cysteine
SQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKCGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLA

SEQ ID NO: 175 - protein, 368 aa, Artificial Sequence
  Polypeptide construct
  MISC_FEATURE (1)..(368): Sequence representing single cysteine substitution mutant made on SEQ ID NO 4, wherein glutamate 148 corresponding to native SK sequence is replaced by cysteine
SQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKCKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLA

SEQ ID NO: 176 - protein, 368 aa, Artificial Sequence
  Polypeptide construct
  MISC_FEATURE (1)..(368): Sequence representing single cysteine substitution mutant made on SEQ ID NO 4, wherein lysine 156 corresponding to native SK sequence is replaced by cysteine
SQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQACSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLA

SEQ ID NO: 177 - protein, 368 aa, Artificial Sequence
  Polypeptide construct
  MISC_FEATURE (1)..(368): Sequence representing single cysteine substitution mutant made on SEQ ID NO 4, wherein aspartate 173 corresponding to native SK sequence is replaced by cysteine
SQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDCDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLA

SEQ ID NO: 178 - protein, 368 aa, Artificial Sequence
  Polypeptide construct
  MISC_FEATURE (1)..(368): Sequence representing single cysteine substitution mutant made on SEQ ID NO 4, wherein aspartate  174 corresponding to native SK sequence is replaced by cysteine
SQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDCFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLA

SEQ ID NO: 179 - protein, 368 aa, Artificial Sequence
  Polypeptide construct
  MISC_FEATURE (1)..(368): Sequence representing single cysteine substitution mutant made on SEQ ID NO 4, wherein leucine 179 corresponding to native SK sequence is replaced by cysteine
SQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGCKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLA

SEQ ID NO: 180 - protein, 368 aa, Artificial Sequence
  Polypeptide construct
  MISC_FEATURE (1)..(368): Sequence representing single cysteine substitution mutant made on SEQ ID NO 4, wherein aspartate 181 corresponding to native SK sequence is replaced by cysteine
SQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKCTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLA

SEQ ID NO: 181 - protein, 368 aa, Artificial Sequence
  Polypeptide construct
  MISC_FEATURE (1)..(368): Sequence representing single cysteine substitution mutant made on SEQ ID NO 4, wherein serine 205 corresponding to native SK sequence is replaced by cysteine
SQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQCILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLA

SEQ ID NO: 182 - protein, 368 aa, Artificial Sequence
  Polypeptide construct
  MISC_FEATURE (1)..(368): Sequence representing single cysteine substitution mutant made on SEQ ID NO 4, wherein alanine 251 corresponding to native SK sequence is replaced by cysteine
SQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQCYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLA

SEQ ID NO: 183 - protein, 368 aa, Artificial Sequence
  Polypeptide construct
  MISC_FEATURE (1)..(368): Sequence representing single cysteine substitution mutant made on SEQ ID NO 4, wherein isoleucine 254 corresponding to native SK sequence is replaced by cysteine
SQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRCNKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLA

SEQ ID NO: 184 - protein, 368 aa, Artificial Sequence
  Polypeptide construct
  MISC_FEATURE (1)..(368): Sequence representing single cysteine substitution mutant made on SEQ ID NO 4, wherein asparagine 255 corresponding to native SK sequence is replaced by cysteine
SQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRICKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLA

SEQ ID NO: 185 - protein, 368 aa, Artificial Sequence
  Polypeptide construct
  MISC_FEATURE (1)..(368): Sequence representing single cysteine substitution mutant made on SEQ ID NO 4, wherein lysine 256 corresponding to native SK sequence is replaced by cysteine
SQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINCKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLA

SEQ ID NO: 186 - protein, 368 aa, Artificial Sequence
  Polypeptide construct
  MISC_FEATURE (1)..(368): Sequence representing single cysteine substitution mutant made on SEQ ID NO 4, wherein lysine 257 corresponding to native SK sequence is replaced by cysteine
SQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKCSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLA

SEQ ID NO: 187 - protein, 368 aa, Artificial Sequence
  Polypeptide construct
  MISC_FEATURE (1)..(368): Sequence representing single cysteine substitution mutant made on SEQ ID NO 4, wherein serine 258 corresponding to native SK sequence is replaced by cysteine
SQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKCGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLA

SEQ ID NO: 188 - protein, 368 aa, Artificial Sequence
  Polypeptide construct
  MISC_FEATURE (1)..(368): Sequence representing single cysteine substitution mutant made on SEQ ID NO 4, wherein leucine 260 corresponding to native SK sequence is replaced by cysteine
SQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGCNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLA

SEQ ID NO: 189 - protein, 368 aa, Artificial Sequence
  Polypeptide construct
  MISC_FEATURE (1)..(368): Sequence representing single cysteine substitution mutant made on SEQ ID NO 4, wherein glutamate 281 corresponding to native SK sequence is replaced by cysteine
SQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGCKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLA

SEQ ID NO: 190 - protein, 368 aa, Artificial Sequence
  Polypeptide construct
  MISC_FEATURE (1)..(368): Sequence representing single cysteine substitution mutant made on SEQ ID NO 4, wherein lysine 282 corresponding to native SK sequence is replaced by cysteine
SQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGECPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLA

SEQ ID NO: 191 - protein, 368 aa, Artificial Sequence
  Polypeptide construct
  MISC_FEATURE (1)..(368): Sequence representing single cysteine substitution mutant made on SEQ ID NO 4, wherein phenyalanine 287 corresponding to native SK sequence is replaced by cysteine
SQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPCDRSHLKLFTIKYVDVDTNELLKSEQLLTASERNLDFRDLYDPRDKAKLLYNNLDAFGIMDYTLTGKVEDNHDDTNRIITVYMGKRPEGENASYHLA

SEQ ID NO: 192 - protein, 368 aa, Artificial Sequence
  Polypeptide construct
  MISC_FEATURE (1)..(368): Sequence representing single cysteine substitution mutant made on SEQ ID NO 4, wherein aspartate 303 corresponding to native SK sequence is replaced by cysteine
SQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVCTNELLKSEQLLTASERNLDFRDLYDPRDKAKLLYNNLDAFGIMDYTLTGKVEDNHDDTNRIITVYMGKRPEGENASYHLA

SEQ ID NO: 193 - protein, 368 aa, Artificial Sequence
  Polypeptide construct
  MISC_FEATURE (1)..(368): Sequence representing single cysteine substitution mutant made on SEQ ID NO 4, wherein leucine 321 corresponding to native SK sequence is replaced by cysteine
SQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNCDFRDLYDPRDKAKLLYNNLDAFGIMDYTLTGKVEDNHDDTNRIITVYMGKRPEGENASYHLA

SEQ ID NO: 194 - protein, 368 aa, Artificial Sequence
  Polypeptide construct
  MISC_FEATURE (1)..(368): Sequence representing single cysteine substitution mutant made on SEQ ID NO 4, wherein leucine 326 corresponding to native SK sequence is replaced by cysteine
SQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDCYDPRDKAKLLYNNLDAFGIMDYTLTGKVEDNHDDTNRIITVYMGKRPEGENASYHLA

SEQ ID NO: 195 - protein, 368 aa, Artificial Sequence
  Polypeptide construct
  MISC_FEATURE (1)..(368): Sequence representing single cysteine substitution mutant made on SEQ ID NO 4, wherein alanine 333 corresponding to native SK sequence is replaced by cysteine
SQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKCKLLYNNLDAFGIMDYTLTGKVEDNHDDTNRIITVYMGKRPEGENASYHLA

SEQ ID NO: 196 - protein, 368 aa, Artificial Sequence
  Polypeptide construct
  MISC_FEATURE (1)..(368): Sequence representing single cysteine substitution mutant made on SEQ ID NO 4, wherein aspartate 347 corresponding to native SK sequence is replaced by cysteine
SQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMCYTLTGKVEDNHDDTNRIITVYMGKRPEGENASYHLA

SEQ ID NO: 197 - protein, 368 aa, Artificial Sequence
  Polypeptide construct
  MISC_FEATURE (1)..(368): Sequence representing single cysteine substitution mutant made on SEQ ID NO 4, wherein aspartate 360 corresponding to native SK sequence is replaced by cysteine
SQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDCTNRIITVYMGKRPEGENASYHLA

SEQ ID NO: 198 - protein, 368 aa, Artificial Sequence
  Polypeptide construct
  MISC_FEATURE (1)..(368): Sequence representing single cysteine substitution mutant made on SEQ ID NO 4, wherein arginine 372 corresponding to native SK sequence is replaced by cysteine
SQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKCPEGENASYHLA

SEQ ID NO: 199 - protein, 368 aa, Artificial Sequence
  Polypeptide construct
  MISC_FEATURE (1)..(368): Sequence representing single cysteine substitution mutant made on SEQ ID NO 4, wherein isoleucine 88 and serine 205 corresponding to native SK sequence are replaced by cysteine
SQLVVSVAGTVEGTNQDISLKFFEIDLTSRPAHGGKTEQGLSPKSKPFATDSGAMSHKLEKADLLKAIQEQLCANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQCILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLA

SEQ ID NO: 200 - protein, 368 aa, Artificial Sequence
  Polypeptide construct
  MISC_FEATURE (1)..(368): Sequence representing single cysteine substitution mutant made on SEQ ID NO 4, wherein serine 93 and asparagines 255 corresponding to native SK sequence are replaced by cysteine
SQLVVSVAGTVEGTNQDISLKFFEIDLTSRPAHGGKTEQGLSPKSKPFATDSGAMSHKLEKADLLKAIQEQLIANVHCNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRICKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLA

SEQ ID NO: 201 - protein, 368 aa, Artificial Sequence
  Polypeptide construct
  MISC_FEATURE (1)..(368): Sequence representing single cysteine substitution mutant made on SEQ ID NO 4, wherein aspartate 102 and arginine 372 corresponding to native SK sequence are replaced by cysteine
SQLVVSVAGTVEGTNQDISLKFFEIDLTSRPAHGGKTEQGLSPKSKPFATDSGAMSHKLEKADLLKAIQEQLIANVHSNDDYFEVICFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKCPEGENASYHLA

SEQ ID NO: 202 - protein, 368 aa, Artificial Sequence
  Polypeptide construct
  MISC_FEATURE (1)..(368): Sequence representing single cysteine substitution mutant made on SEQ ID NO 4, wherein serine 105 and phenylalanine 287 corresponding to native SK sequence are replaced by cysteine
SQLVVSVAGTVEGTNQDISLKFFEIDLTSRPAHGGKTEQGLSPKSKPFATDSGAMSHKLEKADLLKAIQEQLIANVHSNDDYFEVIDFACDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPCDRSHLKLFTIKYVDVDTNELLKSEQLLTASERNLDFRDLYDPRDKAKLLYNNLDAFGIMDYTLTGKVEDNHDDTNRIITVYMGKRPEGENASYHLA

SEQ ID NO: 203 - protein, 368 aa, Artificial Sequence
  Polypeptide construct
  MISC_FEATURE (1)..(368): Sequence representing single cysteine substitution mutant made on SEQ ID NO 4, wherein lysine 121 and aspartate 360 corresponding to native SK sequence are replaced by cysteine
SQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADCDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDCTNRIITVYMGKRPEGENASYHLA

SEQ ID NO: 204 - protein, 368 aa, Artificial Sequence
  Polypeptide construct
  MISC_FEATURE (1)..(368): Sequence representing triple cysteine substitution mutant made on SEQ ID NO 4, wherein Isoleucine 88, serine 205 and arginine 372 corresponding to native SK sequence are replaced by cysteine
SQLVVSVAGTVEGTNQDISLKFFEIDLTSRPAHGGKTEQGLSPKSKPFATDSGAMSHKLEKADLLKAIQEQLCANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQCILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKCPEGENASYHLA

SEQ ID NO: 205 - protein, 368 aa, Artificial Sequence
  Polypeptide construct
  MISC_FEATURE (1)..(368): Sequence representing triple cysteine substitution mutant made on SEQ ID NO 4, wherein serine 93, asparagines 255 and aspartate 347 corresponding to native SK sequence are replaced by cysteine
SQLVVSVAGTVEGTNQDISLKFFEIDLTSRPAHGGKTEQGLSPKSKPFATDSGAMSHKLEKADLLKAIQEQLIANVHCNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRICKKSGLNEEINNTDLISEKYYVLKKGEKPYDPFDRSHLKLFTIKYVDVDTNELLKSEQLLTASERNLDFRDLYDPRDKAKLLYNNLDAFGIMCYTLTGKVEDNHDDTNRIITVYMGKRPEGENASYHLA

SEQ ID NO: 206 - protein, 368 aa, Artificial Sequence
  Polypeptide construct
  MISC_FEATURE (1)..(368): Sequence representing triple cysteine substitution mutant made on SEQ ID NO 4, wherein serine 93, asparagines 255 and phenyalanine 287 corresponding to native SK sequence are replaced by cysteine
SQLVVSVAGTVEGTNQDISLKFFEIDLTSRPAHGGKTEQGLSPKSKPFATDSGAMSHKLEKADLLKAIQEQLIANVHCNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRICKKSGLNEEINNTDLISEKYYVLKKGEKPYDPCDRSHLKLFTIKYVDVDTNELLKSEQLLTASERNLDFRDLYDPRDKAKLLYNNLDAFGIMDYTLTGKVEDNHDDTNRIITVYMGKRPEGENASYHLA

SEQ ID NO: 207 - protein, 368 aa, Artificial Sequence
  Polypeptide construct
  MISC_FEATURE (1)..(368): Sequence representing triple cysteine substitution mutant made on SEQ ID NO 4, wherein aspartate 102, leucine 260 and arginine 372 corresponding to native SK sequence are replaced by cysteine
SQLVVSVAGTVEGTNQDISLKFFEIDLTSRPAHGGKTEQGLSPKSKPFATDSGAMSHKLEKADLLKAIQEQLIANVHSNDDYFEVICFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGCNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKCPEGENASYHLA

SEQ ID NO: 208 - protein, 368 aa, Artificial Sequence
  Polypeptide construct
  MISC_FEATURE (1)..(368): Sequence representing triple cysteine substitution mutant made on SEQ ID NO 4, wherein serine 105, leucine 260 and pheylalanine 287 corresponding to native SK sequence are replaced by cysteine
SQLVVSVAGTVEGTNQDISLKFFEIDLTSRPAHGGKTEQGLSPKSKPFATDSGAMSHKLEKADLLKAIQEQLIANVHSNDDYFEVIDFACDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGCNEEINNTDLISEKYYVLKKGEKPYDPCDRSHLKLFTIKYVDVDTNELLKSEQLLTASERNLDFRDLYDPRDKAKLLYNNLDAFGIMDYTLTGKVEDNHDDTNRIITVYMGKRPEGENASYHLA

SEQ ID NO: 209 - protein, 365 aa, Artificial Sequence
  Polypeptide construct
  MISC_FEATURE (1)..(365): Sequence representing single cysteine substitution mutant made on SEQ ID NO 5, wherein alanine 64 corresponding to native SK sequence is replaced by cysteine
GKTEQGLSPKSKPFCTDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAYDKDRYTEEEREVYSYLRYTGTPIPDNPNDK

SEQ ID NO: 210 - protein, 365 aa, Artificial Sequence
  Polypeptide construct
  MISC_FEATURE (1)..(365): Sequence representing single cysteine substitution mutant made on SEQ ID NO 5, wherein isoleucine 88 corresponding to native SK sequence is replaced by cysteine
GKTEQGLSPKSKPFATDSGAMSHKLEKADLLKAIQEQLCANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAYDKDRYTEEEREVYSYLRYTGTPIPDNPNDK

SEQ ID NO: 211 - protein, 365 aa, Artificial Sequence
  Polypeptide construct
  MISC_FEATURE (1)..(365): Sequence representing single cysteine substitution mutant made on SEQ ID NO 5, wherein serine 93 corresponding to native SK sequence is replaced by cysteine
GKTEQGLSPKSKPFATDSGAMSHKLEKADLLKAIQEQLIANVHCNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAYDKDRYTEEEREVYSYLRYTGTPIPDNPNDK

SEQ ID NO: 212 - protein, 365 aa, Artificial Sequence
  Polypeptide construct
  MISC_FEATURE (1)..(365): Sequence representing single cysteine substitution mutant made on SEQ ID NO 5, wherein aspartate 95 corresponding to native SK sequence is replaced by cysteine
GKTEQGLSPKSKPFATDSGAMSHKLEKADLLKAIQEQLIANVHSNCDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAYDKDRYTEEEREVYSYLRYTGTPIPDNPNDK

SEQ ID NO: 213 - protein, 365 aa, Artificial Sequence
  Polypeptide construct
  MISC_FEATURE (1)..(365): Sequence representing single cysteine substitution mutant made on SEQ ID NO 5, wherein aspartate 96 corresponding to native SK sequence is replaced by cysteine
GKTEQGLSPKSKPFATDSGAMSHKLEKADLLKAIQEQLIANVHSNDCYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAYDKDRYTEEEREVYSYLRYTGTPIPDNPNDK

SEQ ID NO: 214 - protein, 365 aa, Artificial Sequence
  Polypeptide construct
  MISC_FEATURE (1)..(365): Sequence representing single cysteine substitution mutant made on SEQ ID NO 5, wherein aspartate 102 corresponding to native SK sequence is replaced by cysteine
GKTEQGLSPKSKPFATDSGAMSHKLEKADLLKAIQEQLIANVHSNDDYFEVICFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAYDKDRYTEEEREVYSYLRYTGTPIPDNPNDK

SEQ ID NO: 215 - protein, 365 aa, Artificial Sequence
  Polypeptide construct
  MISC_FEATURE (1)..(365): Sequence representing single cysteine substitution mutant made on SEQ ID NO 5, wherein serine 105 corresponding to native SK sequence is replaced by cysteine
GKTEQGLSPKSKPFATDSGAMSHKLEKADLLKAIQEQLIANVHSNDDYFEVIDFACDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAYDKDRYTEEEREVYSYLRYTGTPIPDNPNDK

SEQ ID NO: 216 - protein, 365 aa, Artificial Sequence
  Polypeptide construct
  MISC_FEATURE (1)..(365): Sequence representing single cysteine substitution mutant made on SEQ ID NO 5, wherein aspartate 120 corresponding to native SK sequence is replaced by cysteine
GKTEQGLSPKSKPFATDSGAMSHKLEKADLLKAIQEQLIANVHSNDDYFEVIDFASDATITDRNGKVYFACKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAYDKDRYTEEEREVYSYLRYTGTPIPDNPNDK

SEQ ID NO: 217 - protein, 365 aa, Artificial Sequence
  Polypeptide construct
  MISC_FEATURE (1)..(365): Sequence representing single cysteine substitution mutant made on SEQ ID NO 5, wherein lysine 121 corresponding to native SK sequence is replaced by cysteine
GKTEQGLSPKSKPFATDSGAMSHKLEKADLLKAIQEQLIANVHSNDDYFEVIDFASDATITDRNGKVYFADCDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAYDKDRYTEEEREVYSYLRYTGTPIPDNPNDK

SEQ ID NO: 218 - protein, 365 aa, Artificial Sequence
  Polypeptide construct
  MISC_FEATURE (1)..(365): Sequence representing single cysteine substitution mutant made on SEQ ID NO 5, wherein aspartate 122 corresponding to native SK sequence is replaced by cysteine
GKTEQGLSPKSKPFATDSGAMSHKLEKADLLKAIQEQLIANVHSNDDYFEVIDFASDATITDRNGKVYFADKCGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAYDKDRYTEEEREVYSYLRYTGTPIPDNPNDK

SEQ ID NO: 219 - protein, 365 aa, Artificial Sequence
  Polypeptide construct
  MISC_FEATURE (1)..(365): Sequence representing single cysteine substitution mutant made on SEQ ID NO 5, wherein glutamate 148 corresponding to native SK sequence is replaced by cysteine
GKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKCKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAYDKDRYTEEEREVYSYLRYTGTPIPDNPNDK

SEQ ID NO: 220 - protein, 365 aa, Artificial Sequence
  Polypeptide construct
  MISC_FEATURE (1)..(365): Sequence representing single cysteine substitution mutant made on SEQ ID NO 5, wherein lysine 156 corresponding to native SK sequence is replaced by cysteine
GKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQACSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAYDKDRYTEEEREVYSYLRYTGTPIPDNPNDK

SEQ ID NO: 221 - protein, 365 aa, Artificial Sequence
  Polypeptide construct
  MISC_FEATURE (1)..(365): Sequence representing single cysteine substitution mutant made on SEQ ID NO 5, wherein aspartate 173 corresponding to native SK sequence is replaced by cysteine
GKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDCDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAYDKDRYTEEEREVYSYLRYTGTPIPDNPNDK

SEQ ID NO: 222 - protein, 365 aa, Artificial Sequence
  Polypeptide construct
  MISC_FEATURE (1)..(365): Sequence representing single cysteine substitution mutant made on SEQ ID NO 5, wherein aspartate 174 corresponding to native SK sequence is replaced by cysteine
GKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDCFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAYDKDRYTEEEREVYSYLRYTGTPIPDNPNDK

SEQ ID NO: 223 - protein, 365 aa, Artificial Sequence
  Polypeptide construct
  MISC_FEATURE (1)..(365): Sequence representing single cysteine substitution mutant made on SEQ ID NO 5, wherein leucine 179 corresponding to native SK sequence is replaced by cysteine
GKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGCKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAYDKDRYTEEEREVYSYLRYTGTPIPDNPNDK

SEQ ID NO: 224 - protein, 365 aa, Artificial Sequence
  Polypeptide construct
  MISC_FEATURE (1)..(365): Sequence representing single cysteine substitution mutant made on SEQ ID NO 5, wherein aspartate 181 corresponding to native SK sequence is replaced by cysteine
GKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKCTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAYDKDRYTEEEREVYSYLRYTGTPIPDNPNDK

SEQ ID NO: 225 - protein, 365 aa, Artificial Sequence
  Polypeptide construct
  MISC_FEATURE (1)..(365): Sequence representing single cysteine substitution mutant made on SEQ ID NO 5, wherein serine 205 corresponding to native SK sequence is replaced by cysteine
GKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQCILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAYDKDRYTEEEREVYSYLRYTGTPIPDNPNDK

SEQ ID NO: 226 - protein, 365 aa, Artificial Sequence
  Polypeptide construct
  MISC_FEATURE (1)..(365): Sequence representing single cysteine substitution mutant made on SEQ ID NO 5, wherein alanine 251 corresponding to native SK sequence is replaced by cysteine
GKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQCYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAYDKDRYTEEEREVYSYLRYTGTPIPDNPNDK

SEQ ID NO: 227 - protein, 365 aa, Artificial Sequence
  Polypeptide construct
  MISC_FEATURE (1)..(365): Sequence representing single cysteine substitution mutant made on SEQ ID NO 5, wherein isoleucine 254 corresponding to native SK sequence is replaced by cysteine
GKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRCNKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAYDKDRYTEEEREVYSYLRYTGTPIPDNPNDK

SEQ ID NO: 228 - protein, 365 aa, Artificial Sequence
  Polypeptide construct
  MISC_FEATURE (1)..(365): Sequence representing single cysteine substitution mutant made on SEQ ID NO 5, wherein asparagine 255 corresponding to native SK sequence is replaced by cysteine
GKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRICKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAYDKDRYTEEEREVYSYLRYTGTPIPDNPNDK

SEQ ID NO: 229 - protein, 365 aa, Artificial Sequence
  Polypeptide construct
  MISC_FEATURE (1)..(365): Sequence representing single cysteine substitution mutant made on SEQ ID NO 5, wherein lysine 256 corresponding to native SK sequence is replaced by cysteine
GKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINCKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAYDKDRYTEEEREVYSYLRYTGTPIPDNPNDK

SEQ ID NO: 230 - protein, 365 aa, Artificial Sequence
  Polypeptide construct
  MISC_FEATURE (1)..(365): Sequence representing single cysteine substitution mutant made on SEQ ID NO 5, wherein lysine 257 corresponding to native SK sequence is replaced by cysteine
GKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKCSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAYDKDRYTEEEREVYSYLRYTGTPIPDNPNDK

SEQ ID NO: 231 - protein, 365 aa, Artificial Sequence
  Polypeptide construct
  MISC_FEATURE (1)..(365): Sequence representing single cysteine substitution mutant made on SEQ ID NO 5, wherein serine 258 corresponding to native SK sequence is replaced by cysteine
GKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKCGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAYDKDRYTEEEREVYSYLRYTGTPIPDNPNDK

SEQ ID NO: 232 - protein, 365 aa, Artificial Sequence
  Polypeptide construct
  MISC_FEATURE (1)..(365): Sequence representing single cysteine substitution mutant made on SEQ ID NO 5, wherein leucine 260 corresponding to native SK sequence is replaced by cysteine
GKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGCNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAYDKDRYTEEEREVYSYLRYTGTPIPDNPNDK

SEQ ID NO: 233 - protein, 365 aa, Artificial Sequence
  Polypeptide construct
  MISC_FEATURE (1)..(365): Sequence representing single cysteine substitution mutant made on SEQ ID NO 5, wherein glutamate 281 corresponding to native SK sequence is replaced by cysteine
GKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGCKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAYDKDRYTEEEREVYSYLRYTGTPIPDNPNDK

SEQ ID NO: 234 - protein, 365 aa, Artificial Sequence
  Polypeptide construct
  MISC_FEATURE (1)..(365): Sequence representing single cysteine substitution mutant made on SEQ ID NO 5, wherein lysine 282 corresponding to native SK sequence is replaced by cysteine
GKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGECPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAYDKDRYTEEEREVYSYLRYTGTPIPDNPNDK

SEQ ID NO: 235 - protein, 365 aa, Artificial Sequence
  Polypeptide construct
  MISC_FEATURE (1)..(365): Sequence representing single cysteine substitution mutant made on SEQ ID NO 5, wherein phenyalanine 287 corresponding to native SK sequence is replaced by cysteine
GKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPCDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAYDKDRYTEEEREVYSYLRYTGTPIPDNPNDK

SEQ ID NO: 236 - protein, 365 aa, Artificial Sequence
  Polypeptide construct
  MISC_FEATURE (1)..(365): Sequence representing single cysteine substitution mutant made on SEQ ID NO 5, wherein aspartate 303 corresponding to native SK sequence is replaced by cysteine
GKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVCTNELLKSEQLLTASERNLDFRDLYDPRDKAKLLYNNLDAFGIMDYTLTGKVEDNHDDTNRIITVYMGKRPEGENASYHLAYDKDRYTEEEREVYSYLRYTGTPIPDNPNDK

SEQ ID NO: 237 - protein, 365 aa, Artificial Sequence
  Polypeptide construct
  MISC_FEATURE (1)..(365): Sequence representing single cysteine substitution mutant made on SEQ ID NO 5, wherein leucine 321 corresponding to native SK sequence is replaced by cysteine
GKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNCDFRDLYDPRDKAKLLYNNLDAFGIMDYTLTGKVEDNHDDTNRIITVYMGKRPEGENASYHLAYDKDRYTEEEREVYSYLRYTGTPIPDNPNDK

SEQ ID NO: 238 - protein, 365 aa, Artificial Sequence
  Polypeptide construct
  MISC_FEATURE (1)..(365): Sequence representing single cysteine substitution mutant made on SEQ ID NO 5, wherein leucine 326 corresponding to native SK sequence is replaced by cysteine
GKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDCYDPRDKAKLLYNNLDAFGIMDYTLTGKVEDNHDDTNRIITVYMGKRPEGENASYHLAYDKDRYTEEEREVYSYLRYTGTPIPDNPNDK

SEQ ID NO: 239 - protein, 365 aa, Artificial Sequence
  Polypeptide construct
  MISC_FEATURE (1)..(365): Sequence representing single cysteine substitution mutant made on SEQ ID NO 5, wherein alanine 333 corresponding to native SK sequence is replaced by cysteine
GKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKCKLLYNNLDAFGIMDYTLTGKVEDNHDDTNRIITVYMGKRPEGENASYHLAYDKDRYTEEEREVYSYLRYTGTPIPDNPNDK

SEQ ID NO: 240 - protein, 365 aa, Artificial Sequence
  Polypeptide construct
  MISC_FEATURE (1)..(365): Sequence representing single cysteine substitution mutant made on SEQ ID NO 5, wherein aspartate 347 corresponding to native SK sequence is replaced by cysteine
GKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMCYTLTGKVEDNHDDTNRIITVYMGKRPEGENASYHLAYDKDRYTEEEREVYSYLRYTGTPIPDNPNDK

SEQ ID NO: 241 - protein, 365 aa, Artificial Sequence
  Polypeptide construct
  MISC_FEATURE (1)..(365): Sequence representing single cysteine substitution mutant made on SEQ ID NO 5, wherein aspartate 360 corresponding to native SK sequence is replaced by cysteine
GKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDCTNRIITVYMGKRPEGENASYHLAYDKDRYTEEEREVYSYLRYTGTPIPDNPNDK

SEQ ID NO: 242 - protein, 365 aa, Artificial Sequence
  Polypeptide construct
  MISC_FEATURE (1)..(365): Sequence representing single cysteine substitution mutant made on SEQ ID NO 5, wherein arginine 372 corresponding to native SK sequence is replaced by cysteine
GKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKCPEGENASYHLAYDKDRYTEEEREVYSYLRYTGTPIPDNPNDK

SEQ ID NO: 243 - protein, 365 aa, Artificial Sequence
  Polypeptide construct
  MISC_FEATURE (1)..(365): Sequence representing double cysteine substitution mutant made on SEQ ID NO 5, wherein isoleucine 88 and serine 205 corresponding to native SK sequence are replaced by cysteine
GKTEQGLSPKSKPFATDSGAMSHKLEKADLLKAIQEQLCANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQCILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAYDKDRYTEEEREVYSYLRYTGTPIPDNPNDK

SEQ ID NO: 244 - protein, 365 aa, Artificial Sequence
  Polypeptide construct
  MISC_FEATURE (1)..(365): Sequence representing double cysteine substitution mutant made on SEQ ID NO 5, wherein serine 93 and asparagines 255 corresponding to native SK sequence are replaced by cysteine
GKTEQGLSPKSKPFATDSGAMSHKLEKADLLKAIQEQLIANVHCNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRICKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAYDKDRYTEEEREVYSYLRYTGTPIPDNPNDK

SEQ ID NO: 245 - protein, 365 aa, Artificial Sequence
  Polypeptide construct
  MISC_FEATURE (1)..(365): Sequence representing double cysteine substitution mutant made on SEQ ID NO 5, wherein aspartate 102 and arginine 372 corresponding to native SK sequence are replaced by cysteine
GKTEQGLSPKSKPFATDSGAMSHKLEKADLLKAIQEQLIANVHSNDDYFEVICFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKCPEGENASYHLAYDKDRYTEEEREVYSYLRYTGTPIPDNPNDK

SEQ ID NO: 246 - protein, 365 aa, Artificial Sequence
  Polypeptide construct
  MISC_FEATURE (1)..(365): Sequence representing double cysteine substitution mutant made on SEQ ID NO 5, wherein serine 105 and phenylalanine 287 corresponding to native SK sequence are replaced by cysteine
GKTEQGLSPKSKPFATDSGAMSHKLEKADLLKAIQEQLIANVHSNDDYFEVIDFACDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPCDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAYDKDRYTEEEREVYSYLRYTGTPIPDNPNDK

SEQ ID NO: 247 - protein, 365 aa, Artificial Sequence
  Polypeptide construct
  MISC_FEATURE (1)..(365): Sequence representing double cysteine substitution mutant made on SEQ ID NO 5, wherein Lysine 121 and aspartate 360 corresponding to native SK sequence are replaced by cysteine
GKTEQGLSPKSKPFATDSGAMSHKLEKADLLKAIQEQLIANVHSNDDYFEVIDFASDATITDRNGKVYFADCDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDCTNRIITVYMGKRPEGENASYHLAYDKDRYTEEEREVYSYLRYTGTPIPDNPNDK

SEQ ID NO: 248 - protein, 365 aa, Artificial Sequence
  Polypeptide construct
  MISC_FEATURE (1)..(365): Sequence representing triple cysteine substitution mutant made on SEQ ID NO 5, wherein isoleucine 88, serine 205 and arginine 372 corresponding to native SK sequence are replaced by cysteine
GKTEQGLSPKSKPFATDSGAMSHKLEKADLLKAIQEQLCANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQCILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKCPEGENASYHLAYDKDRYTEEEREVYSYLRYTGTPIPDNPNDK

SEQ ID NO: 249 - protein, 365 aa, Artificial Sequence
  Polypeptide construct
  MISC_FEATURE (1)..(365): Sequence representing triple cysteine substitution mutant made on SEQ ID NO 5, wherein serine 93, asparagines 255 and aspartate 347 corresponding to native SK sequence are replaced by cysteine
GKTEQGLSPKSKPFATDSGAMSHKLEKADLLKAIQEQLIANVHCNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRICKKSGLNEEINNTDLISEKYYVLKKGEKPYDPFDRSHLKLFTIKYVDVDTNELLKSEQLLTASERNLDFRDLYDPRDKAKLLYNNLDAFGIMCYTLTGKVEDNHDDTNRIITVYMGKRPEGENASYHLAYDKDRYTEEEREVYSYLRYTGTPIPDNPNDK

SEQ ID NO: 250 - protein, 365 aa, Artificial Sequence
  Polypeptide construct
  MISC_FEATURE (1)..(365): Sequence representing triple cysteine substitution mutant made on SEQ ID NO 5, wherein serine 93, asparagines 255 and phenyalanine 287 corresponding to native SK sequence are replaced by cysteine
GKTEQGLSPKSKPFATDSGAMSHKLEKADLLKAIQEQLIANVHCNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRICKKSGLNEEINNTDLISEKYYVLKKGEKPYDPCDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAYDKDRYTEEEREVYSYLRYTGTPIPDNPNDK

SEQ ID NO: 251 - protein, 365 aa, Artificial Sequence
  Polypeptide construct
  MISC_FEATURE (1)..(365): Sequence representing triple cysteine substitution mutant made on SEQ ID NO 5, wherein aspartate 102, leucine 260 and arginine 372 corresponding to native SK sequence are replaced by cysteine
GKTEQGLSPKSKPFATDSGAMSHKLEKADLLKAIQEQLIANVHSNDDYFEVICFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGCNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKCPEGENASYHLAYDKDRYTEEEREVYSYLRYTGTPIPDNPNDK

SEQ ID NO: 252 - protein, 365 aa, Artificial Sequence
  Polypeptide construct
  MISC_FEATURE (1)..(365): Sequence representing triple cysteine substitution mutant made on SEQ ID NO 5, wherein serine 105, leucine 260 and phenylalanine 287 corresponding to native SK sequence are replaced by cysteine
GKTEQGLSPKSKPFATDSGAMSHKLEKADLLKAIQEQLIANVHSNDDYFEVIDFACDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGCNEEINNTDLISEKYYVLKKGEKPYDPCDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAYDKDRYTEEEREVYSYLRYTGTPIPDNPNDK

SEQ ID NO: 253 - protein, 324 aa, Artificial Sequence
  Polypeptide construct
  MISC_FEATURE (1)..(324): Sequence representing single cysteine substitution mutant made on SEQ ID NO 6, wherein alanine 64 corresponding to native SK sequence is replaced by cysteine
SKPFCTDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLA

SEQ ID NO: 254 - protein, 324 aa, Artificial Sequence
  Polypeptide construct
  MISC_FEATURE (1)..(324): Sequence representing single cysteine substitution mutant made on SEQ ID NO 6, wherein isoleucine 88 corresponding to native SK sequence is replaced by cysteine
SKPFATDSGAMSHKLEKADLLKAIQEQLCANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLA

SEQ ID NO: 255 - protein, 324 aa, Artificial Sequence
  Polypeptide construct
  MISC_FEATURE (1)..(324): Sequence representing single cysteine substitution mutant made on SEQ ID NO 6, wherein serine 93 corresponding to native SK sequence is replaced by cysteine
SKPFATDSGAMSHKLEKADLLKAIQEQLIANVHCNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLA

SEQ ID NO: 256 - protein, 324 aa, Artificial Sequence
  Polypeptide construct
  MISC_FEATURE (1)..(324): Sequence representing single cysteine substitution mutant made on SEQ ID NO 6, wherein aspartate 95 corresponding to native SK sequence is replaced by cysteine
SKPFATDSGAMSHKLEKADLLKAIQEQLIANVHSNCDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLA

SEQ ID NO: 257 - protein, 324 aa, Artificial Sequence
  Polypeptide construct
  MISC_FEATURE (1)..(324): Sequence representing single cysteine substitution mutant made on SEQ ID NO 6, wherein aspartate 96 corresponding to native SK sequence is replaced by cysteine
SKPFATDSGAMSHKLEKADLLKAIQEQLIANVHSNDCYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLA

SEQ ID NO: 258 - protein, 324 aa, Artificial Sequence
  Polypeptide construct
  MISC_FEATURE (1)..(324): Sequence representing single cysteine substitution mutant made on SEQ ID NO 6, wherein aspartate 102 corresponding to native SK sequence is replaced by cysteine
SKPFATDSGAMSHKLEKADLLKAIQEQLIANVHSNDDYFEVICFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLA

SEQ ID NO: 259 - protein, 324 aa, Artificial Sequence
  Polypeptide construct
  MISC_FEATURE (1)..(324): Sequence representing single cysteine substitution mutant made on SEQ ID NO 6, wherein serine 105 corresponding to native SK sequence is replaced by cysteine
SKPFATDSGAMSHKLEKADLLKAIQEQLIANVHSNDDYFEVIDFACDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLA

SEQ ID NO: 260 - protein, 324 aa, Artificial Sequence
  Polypeptide construct
  MISC_FEATURE (1)..(324): Sequence representing single cysteine substitution mutant made on SEQ ID NO 6, wherein aspartate 120 corresponding to native SK sequence is replaced by cysteine
SKPFATDSGAMSHKLEKADLLKAIQEQLIANVHSNDDYFEVIDFASDATITDRNGKVYFACKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLA

SEQ ID NO: 261 - protein, 324 aa, Artificial Sequence
  Polypeptide construct
  MISC_FEATURE (1)..(324): Sequence representing single cysteine substitution mutant made on SEQ ID NO 6, wherein lysine 121 corresponding to native SK sequence is replaced by cysteine
SKPFATDSGAMSHKLEKADLLKAIQEQLIANVHSNDDYFEVIDFASDATITDRNGKVYFADCDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLA

SEQ ID NO: 262 - protein, 324 aa, Artificial Sequence
  Polypeptide construct
  MISC_FEATURE (1)..(324): Sequence representing single cysteine substitution mutant made on SEQ ID NO 6, wherein aspartate 122 corresponding to native SK sequence is replaced by cysteine
SKPFATDSGAMSHKLEKADLLKAIQEQLIANVHSNDDYFEVIDFASDATITDRNGKVYFADKCGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLA

SEQ ID NO: 263 - protein, 324 aa, Artificial Sequence
  Polypeptide construct
  MISC_FEATURE (1)..(324): Sequence representing single cysteine substitution mutant made on SEQ ID NO 6, wherein glutamate 148 corresponding to native SK sequence is replaced by cysteine
SKPFATDSGAMSHKLEKADLLKAIQEQLIANVHSNDDYFEVIDFASDATITDRNGKVYFADKDGSVTLPTQPVQEFLLSGHVRVRPYKCKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLA

SEQ ID NO: 264 - protein, 324 aa, Artificial Sequence
  Polypeptide construct
  MISC_FEATURE (1)..(324): Sequence representing single cysteine substitution mutant made on SEQ ID NO 6, wherein lysine 156 corresponding to native SK sequence is replaced by cysteine
SKPFATDSGAMSHKLEKADLLKAIQEQLIANVHSNDDYFEVIDFASDATITDRNGKVYFADKDGSVTLPTQPVQEFLLSGHVRVRPYKEKPIQNQACSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLA

SEQ ID NO: 265 - protein, 324 aa, Artificial Sequence
  Polypeptide construct
  MISC_FEATURE (1)..(324): Sequence representing single cysteine substitution mutant made on SEQ ID NO 6, wherein aspartate 173 corresponding to native SK sequence is replaced by cysteine
SKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDCDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLA

SEQ ID NO: 266 - protein, 324 aa, Artificial Sequence
  Polypeptide construct
  MISC_FEATURE (1)..(324): Sequence representing single cysteine substitution mutant made on SEQ ID NO 6, wherein aspartate 174 corresponding to native SK sequence is replaced by cysteine
SKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDCFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLA

SEQ ID NO: 267 - protein, 324 aa, Artificial Sequence
  Polypeptide construct
  MISC_FEATURE (1)..(324): Sequence representing single cysteine substitution mutant made on SEQ ID NO 6, wherein leucine 179 is replaced by cysteine
SKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGCKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLA

SEQ ID NO: 268 - protein, 324 aa, Artificial Sequence
  Polypeptide construct
  MISC_FEATURE (1)..(324): Sequence representing single cysteine substitution mutant made on SEQ ID NO 6, wherein aspartate 181 corresponding to native SK sequence is replaced by cysteine
SKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKCTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLA

SEQ ID NO: 269 - protein, 324 aa, Artificial Sequence
  Polypeptide construct
  MISC_FEATURE (1)..(324): Sequence representing single cysteine substitution mutant made on SEQ ID NO 6, wherein serine 205 corresponding to native SK sequence is replaced by cysteine
SKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQCILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLA

SEQ ID NO: 270 - protein, 324 aa, Artificial Sequence
  Polypeptide construct
  MISC_FEATURE (1)..(324): Sequence representing single cysteine substitution mutant made on SEQ ID NO 6, wherein alanine 251 corresponding to native SK sequence is replaced by cysteine
SKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQCYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLA

SEQ ID NO: 271 - protein, 324 aa, Artificial Sequence
  Polypeptide construct
  MISC_FEATURE (1)..(324): Sequence representing single cysteine substitution mutant made on SEQ ID NO 6, wherein isoleucine 254 corresponding to native SK sequence is replaced by cysteine
SKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRCNKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLA

SEQ ID NO: 272 - protein, 324 aa, Artificial Sequence
  Polypeptide construct
  MISC_FEATURE (1)..(324): Sequence representing single cysteine substitution mutant made on SEQ ID NO 6, wherein asparagine 255 corresponding to native SK sequence is replaced by cysteine
SKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRICKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLA

SEQ ID NO: 273 - protein, 324 aa, Artificial Sequence
  Polypeptide construct
  MISC_FEATURE (1)..(324): Sequence representing single cysteine substitution mutant made on SEQ ID NO 6, wherein lysine 256 corresponding to native SK sequence is replaced by cysteine
SKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINCKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLA

SEQ ID NO: 274 - protein, 324 aa, Artificial Sequence
  Polypeptide construct
  MISC_FEATURE (1)..(324): Sequence representing single cysteine substitution mutant made on SEQ ID NO 6, wherein lysine 257 corresponding to native SK sequence is replaced by cysteine
SKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKCSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLA

SEQ ID NO: 275 - protein, 324 aa, Artificial Sequence
  Polypeptide construct
  MISC_FEATURE (1)..(324): Sequence representing single cysteine substitution mutant made on SEQ ID NO 6, wherein serine 258 corresponding to native SK sequence is replaced by cysteine
SKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKCGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLA

SEQ ID NO: 276 - protein, 324 aa, Artificial Sequence
  Polypeptide construct
  MISC_FEATURE (1)..(324): Sequence representing single cysteine substitution mutant made on SEQ ID NO 6, wherein leucine 260 corresponding to native SK sequence is replaced by cysteine
SKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGCNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLA

SEQ ID NO: 277 - protein, 324 aa, Artificial Sequence
  Polypeptide construct
  MISC_FEATURE (1)..(324): Sequence representing single cysteine substitution mutant made on SEQ ID NO 6, wherein glutamate 281 corresponding to native SK sequence is replaced by cysteine
SKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGCKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLA

SEQ ID NO: 278 - protein, 324 aa, Artificial Sequence
  Polypeptide construct
  MISC_FEATURE (1)..(324): Sequence representing single cysteine substitution mutant made on SEQ ID NO 6, wherein lysine 282 corresponding to native SK sequence is replaced by cysteine
SKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGECPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLA

SEQ ID NO: 279 - protein, 324 aa, Artificial Sequence
  Polypeptide construct
  MISC_FEATURE (1)..(324): Sequence representing single cysteine substitution mutant made on SEQ ID NO 6, wherein phenyalanine 287 corresponding to native SK sequence is replaced by cysteine
SKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPCDRSHLKLFTIKYVDVDTNELLKSEQLLTASERNLDFRDLYDPRDKAKLLYNNLDAFGIMDYTLTGKVEDNHDDTNRIITVYMGKRPEGENASYHLA

SEQ ID NO: 280 - protein, 324 aa, Artificial Sequence
  Polypeptide construct
  MISC_FEATURE (1)..(324): Sequence representing single cysteine substitution mutant made on SEQ ID NO 6, wherein aspartate 303 is corresponding to native SK sequence is replaced by cysteine
SKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVCTNELLKSEQLLTASERNLDFRDLYDPRDKAKLLYNNLDAFGIMDYTLTGKVEDNHDDTNRIITVYMGKRPEGENASYHLA

SEQ ID NO: 281 - protein, 324 aa, Artificial Sequence
  Polypeptide construct
  MISC_FEATURE (1)..(324): Sequence representing single cysteine substitution mutant made on SEQ ID NO 6, wherein leucine 321 corresponding to native SK sequence is replaced by cysteine
SKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNCDFRDLYDPRDKAKLLYNNLDAFGIMDYTLTGKVEDNHDDTNRIITVYMGKRPEGENASYHLA

SEQ ID NO: 282 - protein, 324 aa, Artificial Sequence
  Polypeptide construct
  MISC_FEATURE (1)..(324): Sequence representing single cysteine substitution mutant made on SEQ ID NO 6, wherein leucine 326 corresponding to native SK sequence is replaced by cysteine
SKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDCYDPRDKAKLLYNNLDAFGIMDYTLTGKVEDNHDDTNRIITVYMGKRPEGENASYHLA

SEQ ID NO: 283 - protein, 324 aa, Artificial Sequence
  Polypeptide construct
  MISC_FEATURE (1)..(324): Sequence representing single cysteine substitution mutant made on SEQ ID NO 6, wherein alanine 333 corresponding to native SK sequence is replaced by cysteine
SKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKCKLLYNNLDAFGIMDYTLTGKVEDNHDDTNRIITVYMGKRPEGENASYHLA

SEQ ID NO: 284 - protein, 324 aa, Artificial Sequence
  Polypeptide construct
  MISC_FEATURE (1)..(324): Sequence representing single cysteine substitution mutant made on SEQ ID NO 6, wherein aspartate 347 corresponding to native SK sequence is replaced by cysteine
SKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMCYTLTGKVEDNHDDTNRIITVYMGKRPEGENASYHLA

SEQ ID NO: 285 - protein, 324 aa, Artificial Sequence
  Polypeptide construct
  MISC_FEATURE (1)..(324): Sequence representing single cysteine substitution mutant made on SEQ ID NO 6, wherein aspartate 360 corresponding to native SK sequence is replaced by cysteine
SKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDCTNRIITVYMGKRPEGENASYHLA

SEQ ID NO: 286 - protein, 324 aa, Artificial Sequence
  Polypeptide construct
  MISC_FEATURE (1)..(324): Sequence representing single cysteine substitution mutant made on SEQ ID NO 6, wherein arginine 372 corresponding to native SK sequence is replaced by cysteine
SKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKCPEGENASYHLA

SEQ ID NO: 287 - protein, 324 aa, Artificial Sequence
  Polypeptide construct
  MISC_FEATURE (1)..(324): Sequence representing double cysteine substitution mutant made on SEQ ID NO 6, wherein isoleucine 88 and serine 205 corresponding to native SK sequence are replaced by cysteine
SKPFATDSGAMSHKLEKADLLKAIQEQLCANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQCILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLA

SEQ ID NO: 288 - protein, 324 aa, Artificial Sequence
  Polypeptide construct
  MISC_FEATURE (1)..(324): Sequence representing double cysteine substitution mutant made on SEQ ID NO 6, wherein serine 93 and asparagines 255 corresponding to native SK sequence are replaced by cysteine
SKPFATDSGAMSHKLEKADLLKAIQEQLIANVHCNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRICKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLA

SEQ ID NO: 289 - protein, 324 aa, Artificial Sequence
  Polypeptide construct
  MISC_FEATURE (1)..(324): Sequence representing double cysteine substitution mutant made on SEQ ID NO 6, wherein aspartate 102 and arginine 372 corresponding to native SK sequence are replaced by cysteine
SKPFATDSGAMSHKLEKADLLKAIQEQLIANVHSNDDYFEVICFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKCPEGENASYHLA

SEQ ID NO: 290 - protein, 324 aa, Artificial Sequence
  Polypeptide construct
  MISC_FEATURE (1)..(324): Sequence representing double cysteine substitution mutant made on SEQ ID NO 6, wherein serine 105 and phenylalanine 287 corresponding to native SK sequence are replaced by cysteine
SKPFATDSGAMSHKLEKADLLKAIQEQLIANVHSNDDYFEVIDFACDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPCDRSHLKLFTIKYVDVDTNELLKSEQLLTASERNLDFRDLYDPRDKAKLLYNNLDAFGIMDYTLTGKVEDNHDDTNRIITVYMGKRPEGENASYHLA

SEQ ID NO: 291 - protein, 324 aa, Artificial Sequence
  Polypeptide construct
  MISC_FEATURE (1)..(324): Sequence representing double cysteine substitution mutant made on SEQ ID NO 6, wherein lysine 121 and aspartate 360 corresponding to native SK sequence are replaced by cysteine
SKPFATDSGAMSHKLEKADLLKAIQEQLIANVHSNDDYFEVIDFASDATITDRNGKVYFADCDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDCTNRIITVYMGKRPEGENASYHLA

SEQ ID NO: 292 - protein, 324 aa, Artificial Sequence
  Polypeptide construct
  MISC_FEATURE (1)..(324): Sequence representing triple cysteine substitution mutant made on SEQ ID NO 6, wherein isoleucine 88, serine 205 and arginine 372 corresponding to native SK sequence are replaced by cysteine
SKPFATDSGAMSHKLEKADLLKAIQEQLCANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQCILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKCPEGENASYHLA

SEQ ID NO: 293 - protein, 324 aa, Artificial Sequence
  Polypeptide construct
  MISC_FEATURE (1)..(324): Sequence representing triple cysteine substitution mutant made on SEQ ID NO 6, wherein serine 93, asparagines 255 and aspartate 347 corresponding to native SK sequence are replaced by cysteine
SKPFATDSGAMSHKLEKADLLKAIQEQLIANVHCNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRICKKSGLNEEINNTDLISEKYYVLKKGEKPYDPFDRSHLKLFTIKYVDVDTNELLKSEQLLTASERNLDFRDLYDPRDKAKLLYNNLDAFGIMCYTLTGKVEDNHDDTNRIITVYMGKRPEGENASYHLA

SEQ ID NO: 294 - protein, 324 aa, Artificial Sequence
  Polypeptide construct
  MISC_FEATURE (1)..(324): Sequence representing triple cysteine substitution mutant made on SEQ ID NO 6, wherein serine 93, asparagine 255 and phenyalanine 287 corresponding to native SK sequence are replaced by cysteine
SKPFATDSGAMSHKLEKADLLKAIQEQLIANVHCNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRICKKSGLNEEINNTDLISEKYYVLKKGEKPYDPCDRSHLKLFTIKYVDVDTNELLKSEQLLTASERNLDFRDLYDPRDKAKLLYNNLDAFGIMDYTLTGKVEDNHDDTNRIITVYMGKRPEGENASYHLA

SEQ ID NO: 295 - protein, 324 aa, Artificial Sequence
  Polypeptide construct
  MISC_FEATURE (1)..(324): Sequence representing triple cysteine substitution mutant made on SEQ ID NO 6, wherein aspartate 102, leucine 260 and arginine 372 corresponding to native SK sequence are replaced by cysteine
SKPFATDSGAMSHKLEKADLLKAIQEQLIANVHSNDDYFEVICFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGCNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKCPEGENASYHLA

SEQ ID NO: 296 - protein, 324 aa, Artificial Sequence
  Polypeptide construct
  MISC_FEATURE (1)..(324): Sequence representing triple cysteine substitution mutant made on SEQ ID NO 6, wherein aerine 105, leucine 260 and phenylalanine 287 corresponding to native SK sequence are replaced by cysteine
SKPFATDSGAMSHKLEKADLLKAIQEQLIANVHSNDDYFEVIDFACDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGCNEEINNTDLISEKYYVLKKGEKPYDPCDRSHLKLFTIKYVDVDTNELLKSEQLLTASERNLDFRDLYDPRDKAKLLYNNLDAFGIMDYTLTGKVEDNHDDTNRIITVYMGKRPEGENASYHLA

SEQ ID NO: 297 - protein, 414 aa, Artificial Sequence
  Polypeptide construct
  MISC_FEATURE (1)..(414): Sequence representing single cysteine substitution mutant made on SEQ ID NO 7, wherein Aspartate 102 is replaced by cysteine and asparagines 90 is replaced by alanine
IAGPEWLLDRPSVNNSQLVVSVAGTVEGTNQDISLKFFEIDLTSRPAHGGKTEQGLSPKSKPFATDSGAMSHKLEKADLLKAIQEQLIAAVHSNDDYFEVICFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAYDKDRYTEEEREVYSYLRYTGTPIPDNPNDK

SEQ ID NO: 298 - protein, 414 aa, Artificial Sequence
  Polypeptide construct
  MISC_FEATURE (1)..(414): Sequence representing single cysteine substitution mutant made on SEQ ID NO 7, wherein  Leucine  260  is replaced by cysteine
IAGPEWLLDRPSVNNSQLVVSVAGTVEGTNQDISLKFFEIDLTSRPAHGGKTEQGLSPKSKPFATDSGAMSHKLEKADLLKAIQEQLIAAVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGCNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAYDKDRYTEEEREVYSYLRYTGTPIPDNPNDK

SEQ ID NO: 299 - protein, 414 aa, Artificial Sequence
  Polypeptide construct
  MISC_FEATURE (1)..(414): Sequence representing single cysteine substitution mutant made on SEQ ID NO 7, wherein aspartate 347 is replaced by cysteine and asparagines 90 is replaced by alanine
IAGPEWLLDRPSVNNSQLVVSVAGTVEGTNQDISLKFFEIDLTSRPAHGGKTEQGLSPKSKPFATDSGAMSHKLEKADLLKAIQEQLIAAVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMCYTLTGKVEDNHDDTNRIITVYMGKRPEGENASYHLAYDKDRYTEEEREVYSYLRYTGTPIPDNPNDK

SEQ ID NO: 300 - protein, 414 aa, Artificial Sequence
  Polypeptide construct
  MISC_FEATURE (1)..(414): Sequence representing single cysteine substitution mutant made on SEQ ID NO 8, wherein Aspartate  102  is replaced by cysteine and aspartate 227 is replaced by tyrosine
IAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVICFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHYNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAYDKDRYTEEEREVYSYLRYTGTPIPDNPNDK

SEQ ID NO: 301 - protein, 414 aa, Artificial Sequence
  Polypeptide construct
  MISC_FEATURE (1)..(414): Sequence representing single cysteine substitution mutant made on SEQ ID NO 8, wherein Leucine  260  is replaced by cysteine and aspartate 227 is replaced by tyrosine
IAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHYNDIFRTILPMDQEFTYRVKNREQAYRINKKSGCNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAYDKDRYTEEEREVYSYLRYTGTPIPDNPNDK

SEQ ID NO: 302 - protein, 414 aa, Artificial Sequence
  Polypeptide construct
  MISC_FEATURE (1)..(414): Sequence representing single cysteine substitution mutant made on SEQ ID NO 8, wherein Aspartate 347 is replaced by cysteine and aspartate 227 is replaced by tyrosine
IAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHYNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMCYTLTGKVEDNHDDTNRIITVYMGKRPEGENASYHLAYDKDRYTEEEREVYSYLRYTGTPIPDNPNDK

SEQ ID NO: 303 - protein, 414 aa, Artificial Sequence
  Polypeptide construct
  MISC_FEATURE (1)..(414): Sequence representing single cysteine substitution mutant made on SEQ ID NO 9, wherein aspartate  102 is replaced by cysteine and aspartate 238 is replaced by alanine
IAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVICFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMAQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAYDKDRYTEEEREVYSYLRYTGTPIPDNPNDK

SEQ ID NO: 304 - protein, 414 aa, Artificial Sequence
  Polypeptide construct
  MISC_FEATURE (1)..(414): Sequence representing single cysteine substitution mutant made on SEQ ID NO 9, wherein Leucine  260 is replaced by cysteine and aspartate 238 is replaced by alanine
IAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMAQEFTYRVKNREQAYRINKKSGCNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAYDKDRYTEEEREVYSYLRYTGTPIPDNPNDK

SEQ ID NO: 305 - protein, 414 aa, Artificial Sequence
  Polypeptide construct
  MISC_FEATURE (1)..(414): Sequence representing single cysteine substitution mutant made of SEQ ID NO 9, wherein Aspartate 347 is replaced by cysteine and aspartate 238 is replaced by alanine
IAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMAQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMCYTLTGKVEDNHDDTNRIITVYMGKRPEGENASYHLAYDKDRYTEEEREVYSYLRYTGTPIPDNPNDK

SEQ ID NO: 306 - protein, 414 aa, Artificial Sequence
  Polypeptide construct
  MISC_FEATURE (1)..(414): Sequence representing single cysteine substitution mutant made on SEQ ID NO 10, wherein aspartate  102 is replaced by cysteine and glutamate 240 is replaced by alanine
IAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVICFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQAFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAYDKDRYTEEEREVYSYLRYTGTPIPDNPNDK

SEQ ID NO: 307 - protein, 414 aa, Artificial Sequence
  Polypeptide construct
  MISC_FEATURE (1)..(414): Sequence representing single cysteine substitution mutant made on SEQ ID NO 10, wherein Leucine  260 is replaced by cysteine and glutamate 240 is replaced by alanine
IAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQAFTYRVKNREQAYRINKKSGCNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAYDKDRYTEEEREVYSYLRYTGTPIPDNPNDK

SEQ ID NO: 308 - protein, 414 aa, Artificial Sequence
  Polypeptide construct
  MISC_FEATURE (1)..(414): Sequence representing single cysteine substitution mutant made on SEQ ID NO 10, wherein Aspartate 347 is replaced by cysteine and glutamate 240 is replaced by alanine
IAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQAFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMCYTLTGKVEDNHDDTNRIITVYMGKRPEGENASYHLAYDKDRYTEEEREVYSYLRYTGTPIPDNPNDK

SEQ ID NO: 309 - protein, 414 aa, Artificial Sequence
  Polypeptide construct
  MISC_FEATURE (1)..(414): Sequence representing single cysteine substitution mutant made on SEQ ID NO 11, wherein aspartate 102 is replaced by cysteine and arginine 244 is replaced by alanine
IAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVICFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYAVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAYDKDRYTEEEREVYSYLRYTGTPIPDNPNDK

SEQ ID NO: 310 - protein, 414 aa, Artificial Sequence
  Polypeptide construct
  MISC_FEATURE (1)..(414): Sequence representing single cysteine substitution mutant made on SEQ ID NO 11, wherein leucine  260 is replaced by cysteine and arginine 244 is replaced by alanine
IAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYAVKNREQAYRINKKSGCNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAYDKDRYTEEEREVYSYLRYTGTPIPDNPNDK

SEQ ID NO: 311 - protein, 414 aa, Artificial Sequence
  Polypeptide construct
  MISC_FEATURE (1)..(414): Sequence representing single cysteine substitution mutant made on SEQ ID NO 11, wherein aspartate 347 is replaced by cysteine and arginine 244 is replaced by alanine
IAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYAVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMCYTLTGKVEDNHDDTNRIITVYMGKRPEGENASYHLAYDKDRYTEEEREVYSYLRYTGTPIPDNPNDK

SEQ ID NO: 312 - protein, 414 aa, Artificial Sequence
  Polypeptide construct
  MISC_FEATURE (1)..(414): Sequence representing single cysteine substitution mutant made on SEQ ID NO 12, wherein Aspartate 102 is replaced by cysteine and lysine 246 is replaced by alanine
IAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVICFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVANREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAYDKDRYTEEEREVYSYLRYTGTPIPDNPNDK

SEQ ID NO: 313 - protein, 414 aa, Artificial Sequence
  Polypeptide construct
  MISC_FEATURE (1)..(414): Sequence representing single cysteine substitution mutant made on SEQ ID NO 12, wherein Leucine  260 is replaced by cysteine and lysine 246 is replaced by alanine
IAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVANREQAYRINKKSGCNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAYDKDRYTEEEREVYSYLRYTGTPIPDNPNDK

SEQ ID NO: 314 - protein, 414 aa, Artificial Sequence
  Polypeptide construct
  MISC_FEATURE (1)..(414): Sequence representing single cysteine substitution mutant made on SEQ ID NO 12, wherein aspartate 347 is replaced by cysteine and lysine 246 is replaced by alanine
IAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVANREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMCYTLTGKVEDNHDDTNRIITVYMGKRPEGENASYHLAYDKDRYTEEEREVYSYLRYTGTPIPDNPNDK

SEQ ID NO: 315 - protein, 414 aa, Artificial Sequence
  Polypeptide construct
  MISC_FEATURE (1)..(414): Sequence representing single cysteine substitution mutant made on SEQ ID NO 13, wherein aspartate 102 is replaced by cysteine and leucine 260 is replaced by alanine
IAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVICFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGANEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAYDKDRYTEEEREVYSYLRYTGTPIPDNPNDK

SEQ ID NO: 316 - protein, 414 aa, Artificial Sequence
  Polypeptide construct
  MISC_FEATURE (1)..(414): Sequence representing single cysteine substitution mutant made on SEQ ID NO 13, wherein asparagine 255 is replaced by cysteine and leucine 260 is replaced by alanine
IAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRICKKSGANEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAYDKDRYTEEEREVYSYLRYTGTPIPDNPNDK

SEQ ID NO: 317 - protein, 414 aa, Artificial Sequence
  Polypeptide construct
  MISC_FEATURE (1)..(414): Sequence representing single cysteine substitution mutant made on SEQ ID NO 13, wherein aspartate 347 is replaced by cysteine and leucine 260 is replaced by alanine
IAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGANEEINNTDLISEKYYVLKKGEKPYDPFDRSHLKLFTIKYVDVDTNELLKSEQLLTASERNLDFRDLYDPRDKAKLLYNNLDAFGIMCYTLTGKVEDNHDDTNRIITVYMGKRPEGENASYHLAYDKDRYTEEEREVYSYLRYTGTPIPDNPNDK

SEQ ID NO: 318 - protein, 414 aa, Artificial Sequence
  Polypeptide construct
  MISC_FEATURE (1)..(414): Sequence representing single cysteine substitution mutant made on SEQ ID NO 14, wherein Aspartate 102 is replaced by cysteine and aspartate 359 is replaced by argainine
IAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVICFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHRDTNRIITVYMGKRPEGENASYHLAYDKDRYTEEEREVYSYLRYTGTPIPDNPNDK

SEQ ID NO: 319 - protein, 414 aa, Artificial Sequence
  Polypeptide construct
  MISC_FEATURE (1)..(414): Sequence representing single cysteine substitution mutant made on SEQ ID NO 14, wherein leucine 260 is replaced by cysteine and aspartate 359 is replaced by argainine
IAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGCNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHRDTNRIITVYMGKRPEGENASYHLAYDKDRYTEEEREVYSYLRYTGTPIPDNPNDK

SEQ ID NO: 320 - protein, 414 aa, Artificial Sequence
  Polypeptide construct
  MISC_FEATURE (1)..(414): Sequence representing single cysteine substitution mutant made on SEQ ID NO 14, wherein aspartate 347 is replaced by cysteine and aspartate 359 is replaced by argainine
IAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMCYTLTGKVEDNHRDTNRIITVYMGKRPEGENASYHLAYDKDRYTEEEREVYSYLRYTGTPIPDNPNDK

SEQ ID NO: 321 - protein, 414 aa, Artificial Sequence
  Polypeptide construct
  MISC_FEATURE (1)..(414): Sequence representing single cysteine substitution mutant made on SEQ ID NO 15, wherein  Aspartate 102 is replaced by cysteine and histidine 92, serine 93 are replaced by alanine
IAGPEWLLDRPSVNNSQLVVSVAGTVEGTNQDISLKFFEIDLTSRPAHGGKTEQGLSPKSKPFATDSGAMSHKLEKADLLKAIQEQLIANVAANDDYFEVICFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAYDKDRYTEEEREVYSYLRYTGTPIPDNPNDK

SEQ ID NO: 322 - protein, 414 aa, Artificial Sequence
  Polypeptide construct
  MISC_FEATURE (1)..(414): Sequence representing single cysteine substitution mutant made on SEQ ID NO 15, wherein leucine  260  is replaced by cysteine and histidine 92, serine 93 are replaced by alanine
IAGPEWLLDRPSVNNSQLVVSVAGTVEGTNQDISLKFFEIDLTSRPAHGGKTEQGLSPKSKPFATDSGAMSHKLEKADLLKAIQEQLIANVAANDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGCNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAYDKDRYTEEEREVYSYLRYTGTPIPDNPNDK

SEQ ID NO: 323 - protein, 414 aa, Artificial Sequence
  Polypeptide construct
  MISC_FEATURE (1)..(414): Sequence representing single cysteine substitution mutant made on SEQ ID NO 15, wherein aspartate 347 is replaced by cysteine and histidine 92, serine 93 are replaced by alanine
IAGPEWLLDRPSVNNSQLVVSVAGTVEGTNQDISLKFFEIDLTSRPAHGGKTEQGLSPKSKPFATDSGAMSHKLEKADLLKAIQEQLIANVAANDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMCYTLTGKVEDNHDDTNRIITVYMGKRPEGENASYHLAYDKDRYTEEEREVYSYLRYTGTPIPDNPNDK

SEQ ID NO: 324 - protein, 414 aa, Artificial Sequence
  Polypeptide construct
  MISC_FEATURE (1)..(414): Sequence representing single cysteine substitution mutant made on SEQ ID NO 16, wherein Aspartate 102 is replaced by cysteine and lysine 278, lysine 279 are replaced by alanine
IAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVICFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLAAGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAYDKDRYTEEEREVYSYLRYTGTPIPDNPNDK

SEQ ID NO: 325 - protein, 414 aa, Artificial Sequence
  Polypeptide construct
  MISC_FEATURE (1)..(414): Sequence representing single cysteine substitution mutant made on SEQ ID NO 16, wherein leucine 260 is replaced by cysteine and lysine 278, lysine 279 are replaced by alanine
IAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGCNEEINNTDLISEKYYVLAAGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAYDKDRYTEEEREVYSYLRYTGTPIPDNPNDK

SEQ ID NO: 326 - protein, 414 aa, Artificial Sequence
  Polypeptide construct
  MISC_FEATURE (1)..(414): Sequence representing single cysteine substitution mutant made on SEQ ID NO 16, wherein Aspartate 347 is replaced by cysteine and lysine 278, lysine 279 are replaced by alanine
IAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLAAGEKPYDPFDRSHLKLFTIKYVDVDTNELLKSEQLLTASERNLDFRDLYDPRDKAKLLYNNLDAFGIMCYTLTGKVEDNHDDTNRIITVYMGKRPEGENASYHLAYDKDRYTEEEREVYSYLRYTGTPIPDNPNDK

SEQ ID NO: 327 - protein, 413 aa, Artificial Sequence
  Polypeptide construct
  MISC_FEATURE (1)..(413): Sequence representing single cysteine substitution mutant made on SEQ ID NO 17, wherein aspartate 101 is replaced by cysteine and asparagine 90 is deleted
IAGPEWLLDRPSVNNSQLVVSVAGTVEGTNQDISLKFFEIDLTSRPAHGGKTEQGLSPKSKPFATDSGAMSHKLEKADLLKAIQEQLIAVHSNDDYFEVICFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAYDKDRYTEEEREVYSYLRYTGTPIPDNPNDK

SEQ ID NO: 328 - protein, 413 aa, Artificial Sequence
  Polypeptide construct
  MISC_FEATURE (1)..(413): Sequence representing single cysteine substitution mutant made on SEQ ID NO 17, wherein Leucine 259 is replaced by cysteine and asparagine 90 is deleted
IAGPEWLLDRPSVNNSQLVVSVAGTVEGTNQDISLKFFEIDLTSRPAHGGKTEQGLSPKSKPFATDSGAMSHKLEKADLLKAIQEQLIAVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGCNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAYDKDRYTEEEREVYSYLRYTGTPIPDNPNDK

SEQ ID NO: 329 - protein, 413 aa, Artificial Sequence
  Polypeptide construct
  MISC_FEATURE (1)..(413): Sequence representing single cysteine substitution mutant made on SEQ ID NO 17, wherein Aspartate 346 is replaced by cysteine and asparagine 90 is deleted
IAGPEWLLDRPSVNNSQLVVSVAGTVEGTNQDISLKFFEIDLTSRPAHGGKTEQGLSPKSKPFATDSGAMSHKLEKADLLKAIQEQLIAVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMCYTLTGKVEDNHDDTNRIITVYMGKRPEGENASYHLAYDKDRYTEEEREVYSYLRYTGTPIPDNPNDK

SEQ ID NO: 330 - protein, 413 aa, Artificial Sequence
  Polypeptide construct
  MISC_FEATURE (1)..(413): Sequence representing single cysteine substitution mutant made on SEQ ID NO 18, wherein Aspartate 102 is replaced by cysteine and aspartate 227 is deleted
IAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVICFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAYDKDRYTEEEREVYSYLRYTGTPIPDNPNDK

SEQ ID NO: 331 - protein, 413 aa, Artificial Sequence
  Polypeptide construct
  MISC_FEATURE (1)..(413): Sequence representing single cysteine substitution mutant made on SEQ ID NO 18, wherein leucine 259 is replaced by cysteine and aspartate 227 is deleted
IAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHNDIFRTILPMDQEFTYRVKNREQAYRINKKSGCNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAYDKDRYTEEEREVYSYLRYTGTPIPDNPNDK

SEQ ID NO: 332 - protein, 413 aa, Artificial Sequence
  Polypeptide construct
  MISC_FEATURE (1)..(413): Sequence representing single cysteine substitution mutant made on SEQ ID NO 18, wherein aspartate 346 is replaced by cysteine and aspartate 227 is deleted
IAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMCYTLTGKVEDNHDDTNRIITVYMGKRPEGENASYHLAYDKDRYTEEEREVYSYLRYTGTPIPDNPNDK

SEQ ID NO: 333 - protein, 413 aa, Artificial Sequence
  Polypeptide construct
  MISC_FEATURE (1)..(413): Sequence representing single cysteine substitution mutant made on SEQ ID NO 19, wherein aspartate 102 is replaced by cysteine and aspartate 359 is deleted
IAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVICFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDTNRIITVYMGKRPEGENASYHLAYDKDRYTEEEREVYSYLRYTGTPIPDNPNDK

SEQ ID NO: 334 - protein, 413 aa, Artificial Sequence
  Polypeptide construct
  MISC_FEATURE (1)..(413): Sequence representing single cysteine substitution mutant made on SEQ ID NO 19, wherein leucine 260 is replaced by cysteine and aspartate 359 is deleted
IAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGCNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDTNRIITVYMGKRPEGENASYHLAYDKDRYTEEEREVYSYLRYTGTPIPDNPNDK

SEQ ID NO: 335 - protein, 413 aa, Artificial Sequence
  Polypeptide construct
  MISC_FEATURE (1)..(413): Sequence representing single cysteine substitution mutant made on SEQ ID NO 19, wherein aspartate 347 is replaced by cysteine and aspartate 359 is deleted
IAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMCYTLTGKVEDNHDTNRIITVYMGKRPEGENASYHLAYDKDRYTEEEREVYSYLRYTGTPIPDNPNDK

SEQ ID NO: 336 - protein, 406 aa, Artificial Sequence
  Polypeptide construct
  MISC_FEATURE (1)..(406): Sequence representing single cysteine substitution mutant made on SEQ ID NO 20, wherein Isoleucine 80 is replaced by cysteine
IAGPEWLLDRPSVNNSQLVVSVAGTVEGTNQEISLKFFEIDLTSRPAQGGKTEPGLRPKSKMPYKLEKADLLKAIQEQLCANVHSNDGYFEVIDFASDATITDRNGKVYFADRDDSVTLPTQPVQEFLLSGHVRVRPYRPKAVHNSAERVNVNYEVSFVSETGDLDFTPSLRDRYHLTTLAVGDSLSSQELAAIAQFILSKEHPDYIITKRDSSIVTHDNDIFRTILPMDQEFTYHVKDREQAYGINKKSGQKEKINNTDLISEKYYVLKKGEKPYDPFDRSHLKLFTINYVDVDTNKLLKSEQLLTASERNLDFRDLYDPRDKAKLLYNNLDAFGIMDYTLTGKVEDNHDDTNRIITVYMGKRPEGENASYHLAYDKDRYTEEEREVYSYLRYTGTPIPDNPKDK

SEQ ID NO: 337 - protein, 406 aa, Artificial Sequence
  Polypeptide construct
  MISC_FEATURE (1)..(406): Sequence representing single cysteine substitution mutant made on SEQ ID NO 20, wherein serine 85 is replaced by cysteine
IAGPEWLLDRPSVNNSQLVVSVAGTVEGTNQEISLKFFEIDLTSRPAQGGKTEPGLRPKSKMPYKLEKADLLKAIQEQLIANVHCNDGYFEVIDFASDATITDRNGKVYFADRDDSVTLPTQPVQEFLLSGHVRVRPYRPKAVHNSAERVNVNYEVSFVSETGDLDFTPSLRDRYHLTTLAVGDSLSSQELAAIAQFILSKEHPDYIITKRDSSIVTHDNDIFRTILPMDQEFTYHVKDREQAYGINKKSGQKEKINNTDLISEKYYVLKKGEKPYDPFDRSHLKLFTINYVDVDTNKLLKSEQLLTASERNLDFRDLYDPRDKAKLLYNNLDAFGIMDYTLTGKVEDNHDDTNRIITVYMGKRPEGENASYHLAYDKDRYTEEEREVYSYLRYTGTPIPDNPKDK

SEQ ID NO: 338 - protein, 406 aa, Artificial Sequence
  Polypeptide construct
  MISC_FEATURE (1)..(406): Sequence representing single cysteine substitution mutant made on SEQ ID NO 20, wherein aspartate 94 is replaced by cysteine
IAGPEWLLDRPSVNNSQLVVSVAGTVEGTNQEISLKFFEIDLTSRPAQGGKTEPGLRPKSKMPYKLEKADLLKAIQEQLIANVHSNDGYFEVICFASDATITDRNGKVYFADRDDSVTLPTQPVQEFLLSGHVRVRPYRPKAVHNSAERVNVNYEVSFVSETGDLDFTPSLRDRYHLTTLAVGDSLSSQELAAIAQFILSKEHPDYIITKRDSSIVTHDNDIFRTILPMDQEFTYHVKDREQAYGINKKSGQKEKINNTDLISEKYYVLKKGEKPYDPFDRSHLKLFTINYVDVDTNKLLKSEQLLTASERNLDFRDLYDPRDKAKLLYNNLDAFGIMDYTLTGKVEDNHDDTNRIITVYMGKRPEGENASYHLAYDKDRYTEEEREVYSYLRYTGTPIPDNPKDK

SEQ ID NO: 339 - protein, 406 aa, Artificial Sequence
  Polypeptide construct
  MISC_FEATURE (1)..(406): Sequence representing single cysteine substitution mutant made on SEQ ID NO 20, wherein Isoleucine 246 is replaced by cysteine
IAGPEWLLDRPSVNNSQLVVSVAGTVEGTNQEISLKFFEIDLTSRPAQGGKTEPGLRPKSKMPYKLEKADLLKAIQEQLIANVHSNDGYFEVIDFASDATITDRNGKVYFADRDDSVTLPTQPVQEFLLSGHVRVRPYRPKAVHNSAERVNVNYEVSFVSETGDLDFTPSLRDRYHLTTLAVGDSLSSQELAAIAQFILSKEHPDYIITKRDSSIVTHDNDIFRTILPMDQEFTYHVKDREQAYGCNKKSGQKEKINNTDLISEKYYVLKKGEKPYDPFDRSHLKLFTINYVDVDTNKLLKSEQLLTASERNLDFRDLYDPRDKAKLLYNNLDAFGIMDYTLTGKVEDNHDDTNRIITVYMGKRPEGENASYHLAYDKDRYTEEEREVYSYLRYTGTPIPDNPKDK

SEQ ID NO: 340 - protein, 406 aa, Artificial Sequence
  Polypeptide construct
  MISC_FEATURE (1)..(406): Sequence representing single cysteine substitution mutant made on SEQ ID NO 20, wherein aspartate 339 is replaced by cysteine
IAGPEWLLDRPSVNNSQLVVSVAGTVEGTNQEISLKFFEIDLTSRPAQGGKTEPGLRPKSKMPYKLEKADLLKAIQEQLIANVHSNDGYFEVIDFASDATITDRNGKVYFADRDDSVTLPTQPVQEFLLSGHVRVRPYRPKAVHNSAERVNVNYEVSFVSETGDLDFTPSLRDRYHLTTLAVGDSLSSQELAAIAQFILSKEHPDYIITKRDSSIVTHDNDIFRTILPMDQEFTYHVKDREQAYGINKKSGQKEKINNTDLISEKYYVLKKGEKPYDPFDRSHLKLFTINYVDVDTNKLLKSEQLLTASERNLDFRDLYDPRDKAKLLYNNLDAFGIMCYTLTGKVEDNHDDTNRIITVYMGKRPEGENASYHLAYDKDRYTEEEREVYSYLRYTGTPIPDNPKDK

SEQ ID NO: 341 - protein, 406 aa, Artificial Sequence
  Polypeptide construct
  MISC_FEATURE (1)..(406): Sequence representing single cysteine substitution mutant made on SEQ ID NO 20, wherein arginine 364 is replaced by cysteine
IAGPEWLLDRPSVNNSQLVVSVAGTVEGTNQEISLKFFEIDLTSRPAQGGKTEPGLRPKSKMPYKLEKADLLKAIQEQLIANVHSNDGYFEVIDFASDATITDRNGKVYFADRDDSVTLPTQPVQEFLLSGHVRVRPYRPKAVHNSAERVNVNYEVSFVSETGDLDFTPSLRDRYHLTTLAVGDSLSSQELAAIAQFILSKEHPDYIITKRDSSIVTHDNDIFRTILPMDQEFTYHVKDREQAYGINKKSGQKEKINNTDLISEKYYVLKKGEKPYDPFDRSHLKLFTINYVDVDTNKLLKSEQLLTASERNLDFRDLYDPRDKAKLLYNNLDAFGIMDYTLTGKVEDNHDDTNRIITVYMGKCPEGENASYHLAYDKDRYTEEEREVYSYLRYTGTPIPDNPKDK

SEQ ID NO: 342 - protein, 414 aa, Artificial Sequence
  Polypeptide construct
  MISC_FEATURE (1)..(414): Sequence representing single cysteine substitution mutant made on SEQ ID NO 21, wherein isoleucine 88 is replaced by cysteine
IAGPEWLLDRPSVNNSQLVVSVAGTVEGTNQDISLKFFEIDLTSRPAHGGKTEQGLSPKSKPFATDSGAMPHKLEKADLLKAIQEQLCANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKTHPGYTIYERDSSIVTHDNDIFRTILPMDQEFTYHVKNREQAYEINKKSGLNEEINNTDLISEKYYVLKKGEKPYDPFDRSHLKLFTIKYVDVNTNELLKSEQLLTASERNLDFRDLYDPRDKAKLLYNNLDAFGIMDYTLTGKVEDNHDDTNRIITVYMGKRPEGENASYHLAYDKDRYTEEEREVYSYLRYTGTPIPDNPNDK

SEQ ID NO: 343 - protein, 414 aa, Artificial Sequence
  Polypeptide construct
  MISC_FEATURE (1)..(414): Sequence representing single cysteine substitution mutant made on SEQ ID NO 21, wherein serine 93 is replaced by cysteine
IAGPEWLLDRPSVNNSQLVVSVAGTVEGTNQDISLKFFEIDLTSRPAHGGKTEQGLSPKSKPFATDSGAMPHKLEKADLLKAIQEQLIANVHCNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKTHPGYTIYERDSSIVTHDNDIFRTILPMDQEFTYHVKNREQAYEINKKSGLNEEINNTDLISEKYYVLKKGEKPYDPFDRSHLKLFTIKYVDVNTNELLKSEQLLTASERNLDFRDLYDPRDKAKLLYNNLDAFGIMDYTLTGKVEDNHDDTNRIITVYMGKRPEGENASYHLAYDKDRYTEEEREVYSYLRYTGTPIPDNPNDK

SEQ ID NO: 344 - protein, 414 aa, Artificial Sequence
  Polypeptide construct
  MISC_FEATURE (1)..(414): Sequence representing single cysteine substitution mutant made on SEQ ID NO 21, wherein aspartate  102 is replaced by cysteine
IAGPEWLLDRPSVNNSQLVVSVAGTVEGTNQDISLKFFEIDLTSRPAHGGKTEQGLSPKSKPFATDSGAMPHKLEKADLLKAIQEQLIANVHSNDDYFEVICFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKTHPGYTIYERDSSIVTHDNDIFRTILPMDQEFTYHVKNREQAYEINKKSGLNEEINNTDLISEKYYVLKKGEKPYDPFDRSHLKLFTIKYVDVNTNELLKSEQLLTASERNLDFRDLYDPRDKAKLLYNNLDAFGIMDYTLTGKVEDNHDDTNRIITVYMGKRPEGENASYHLAYDKDRYTEEEREVYSYLRYTGTPIPDNPNDK

SEQ ID NO: 345 - protein, 414 aa, Artificial Sequence
  Polypeptide construct
  MISC_FEATURE (1)..(414): Sequence representing single cysteine substitution mutant made on SEQ ID NO 21, wherein leucine 260 is replaced by cysteine
IAGPEWLLDRPSVNNSQLVVSVAGTVEGTNQDISLKFFEIDLTSRPAHGGKTEQGLSPKSKPFATDSGAMPHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKTHPGYTIYERDSSIVTHDNDIFRTILPMDQEFTYHVKNREQAYEINKKSGCNEEINNTDLISEKYYVLKKGEKPYDPFDRSHLKLFTIKYVDVNTNELLKSEQLLTASERNLDFRDLYDPRDKAKLLYNNLDAFGIMDYTLTGKVEDNHDDTNRIITVYMGKRPEGENASYHLAYDKDRYTEEEREVYSYLRYTGTPIPDNPNDK

SEQ ID NO: 346 - protein, 414 aa, Artificial Sequence
  Polypeptide construct
  MISC_FEATURE (1)..(414): Sequence representing single cysteine substitution mutant made on SEQ ID NO 21, wherein aspartate 347 is replaced by cysteine
IAGPEWLLDRPSVNNSQLVVSVAGTVEGTNQDISLKFFEIDLTSRPAHGGKTEQGLSPKSKPFATDSGAMPHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKTHPGYTIYERDSSIVTHDNDIFRTILPMDQEFTYHVKNREQAYEINKKSGLNEEINNTDLISEKYYVLKKGEKPYDPFDRSHLKLFTIKYVDVNTNELLKSEQLLTASERNLDFRDLYDPRDKAKLLYNNLDAFGIMCYTLTGKVEDNHDDTNRIITVYMGKRPEGENASYHLAYDKDRYTEEEREVYSYLRYTGTPIPDNPNDK

SEQ ID NO: 347 - protein, 414 aa, Artificial Sequence
  Polypeptide construct
  MISC_FEATURE (1)..(414): Sequence representing single cysteine substitution mutant made on SEQ ID NO 21, wherein arginine 372 is replaced by cysteine
IAGPEWLLDRPSVNNSQLVVSVAGTVEGTNQDISLKFFEIDLTSRPAHGGKTEQGLSPKSKPFATDSGAMPHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKTHPGYTIYERDSSIVTHDNDIFRTILPMDQEFTYHVKNREQAYEINKKSGLNEEINNTDLISEKYYVLKKGEKPYDPFDRSHLKLFTIKYVDVNTNELLKSEQLLTASERNLDFRDLYDPRDKAKLLYNNLDAFGIMDYTLTGKVEDNHDDTNRIITVYMGKCPEGENASYHLAYDKDRYTEEEREVYSYLRYTGTPIPDNPNDK

SEQ ID NO: 348 - protein, 531 aa, Artificial Sequence
  Polypeptide construct
  MISC_FEATURE (1)..(531): Sequence representing single cysteine substitution mutant made on SEQ ID NO 22, wherein histidine 16 is replaced by cysteine
VQAQQIVPIAEKCFDCAAGTSYVVGETWEKPYQGWMMVDCTCLGEGSGRITCTSRNRCNDQDSRTSYRIGDTWSKKDNRGNLLQCICTGNGRGEWKCERHTSVQTTSSGSGPFTDVRIAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAYDKDRYTEEEREVYSYLRYTGTPIPDNPNDK

SEQ ID NO: 349 - protein, 531 aa, Artificial Sequence
  Polypeptide construct
  MISC_FEATURE (1)..(531): Sequence representing single cysteine substitution mutant made on SEQ ID NO 22, wherein alanine 17 is replaced by cysteine
VQAQQIVPIAEKCFDHCAGTSYVVGETWEKPYQGWMMVDCTCLGEGSGRITCTSRNRCNDQDSRTSYRIGDTWSKKDNRGNLLQCICTGNGRGEWKCERHTSVQTTSSGSGPFTDVRIAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAYDKDRYTEEEREVYSYLRYTGTPIPDNPNDK

SEQ ID NO: 350 - protein, 531 aa, Artificial Sequence
  Polypeptide construct
  MISC_FEATURE (1)..(531): Sequence representing single cysteine substitution mutant made on SEQ ID NO 22, wherein aspartate 62 is replaced by cysteine
VQAQQIVPIAEKCFDHAAGTSYVVGETWEKPYQGWMMVDCTCLGEGSGRITCTSRNRCNDQCSRTSYRIGDTWSKKDNRGNLLQCICTGNGRGEWKCERHTSVQTTSSGSGPFTDVRIAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAYDKDRYTEEEREVYSYLRYTGTPIPDNPNDK

SEQ ID NO: 351 - protein, 531 aa, Artificial Sequence
  Polypeptide construct
  MISC_FEATURE (1)..(531): Sequence representing single cysteine substitution mutant made on SEQ ID NO 22, wherein glycine  80 is replaced by cysteine
VQAQQIVPIAEKCFDHAAGTSYVVGETWEKPYQGWMMVDCTCLGEGSGRITCTSRNRCNDQDSRTSYRIGDTWSKKDNRCNLLQCICTGNGRGEWKCERHTSVQTTSSGSGPFTDVRIAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAYDKDRYTEEEREVYSYLRYTGTPIPDNPNDK

SEQ ID NO: 352 - protein, 531 aa, Artificial Sequence
  Polypeptide construct
  MISC_FEATURE (1)..(531): Sequence representing single cysteine substitution mutant made on SEQ ID NO 22, wherein glycine 166 is replaced by cysteine
VQAQQIVPIAEKCFDHAAGTSYVVGETWEKPYQGWMMVDCTCLGEGSGRITCTSRNRCNDQDSRTSYRIGDTWSKKDNRGNLLQCICTGNGRGEWKCERHTSVQTTSSGSGPFTDVRIAGPEWLLDRPSVNNSQLVVSVAGTVEGTNQDISLKFFEIDLTSRPAHCGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAYDKDRYTEEEREVYSYLRYTGTPIPDNPNDK

SEQ ID NO: 353 - protein, 531 aa, Artificial Sequence
  Polypeptide construct
  MISC_FEATURE (1)..(531): Sequence representing single cysteine substitution mutant made on SEQ ID NO 22, wherein serine 174 is replaced by cysteine
VQAQQIVPIAEKCFDHAAGTSYVVGETWEKPYQGWMMVDCTCLGEGSGRITCTSRNRCNDQDSRTSYRIGDTWSKKDNRGNLLQCICTGNGRGEWKCERHTSVQTTSSGSGPFTDVRIAGPEWLLDRPSVNNSQLVVSVAGTVEGTNQDISLKFFEIDLTSRPAHGGKTEQGLCPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAYDKDRYTEEEREVYSYLRYTGTPIPDNPNDK

SEQ ID NO: 354 - protein, 531 aa, Artificial Sequence
  Polypeptide construct
  MISC_FEATURE (1)..(531): Sequence representing single cysteine substitution mutant made on SEQ ID NO 22, wherein alanine 181 is replaced by cysteine
VQAQQIVPIAEKCFDHAAGTSYVVGETWEKPYQGWMMVDCTCLGEGSGRITCTSRNRCNDQDSRTSYRIGDTWSKKDNRGNLLQCICTGNGRGEWKCERHTSVQTTSSGSGPFTDVRIAGPEWLLDRPSVNNSQLVVSVAGTVEGTNQDISLKFFEIDLTSRPAHGGKTEQGLSPKSKPFCTDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAYDKDRYTEEEREVYSYLRYTGTPIPDNPNDK

SEQ ID NO: 355 - protein, 531 aa, Artificial Sequence
  Polypeptide construct
  MISC_FEATURE (1)..(531): Sequence representing single cysteine substitution mutant made on SEQ ID NO 22, wherein isoleucine 205 is replaced by cysteine
VQAQQIVPIAEKCFDHAAGTSYVVGETWEKPYQGWMMVDCTCLGEGSGRITCTSRNRCNDQDSRTSYRIGDTWSKKDNRGNLLQCICTGNGRGEWKCERHTSVQTTSSGSGPFTDVRIAGPEWLLDRPSVNNSQLVVSVAGTVEGTNQDISLKFFEIDLTSRPAHGGKTEQGLSPKSKPFATDSGAMSHKLEKADLLKAIQEQLCANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAYDKDRYTEEEREVYSYLRYTGTPIPDNPNDK

SEQ ID NO: 356 - protein, 531 aa, Artificial Sequence
  Polypeptide construct
  MISC_FEATURE (1)..(531): Sequence representing single cysteine substitution mutant made on SEQ ID NO 22, wherein serine 210 is replaced by cysteine
VQAQQIVPIAEKCFDHAAGTSYVVGETWEKPYQGWMMVDCTCLGEGSGRITCTSRNRCNDQDSRTSYRIGDTWSKKDNRGNLLQCICTGNGRGEWKCERHTSVQTTSSGSGPFTDVRIAGPEWLLDRPSVNNSQLVVSVAGTVEGTNQDISLKFFEIDLTSRPAHGGKTEQGLSPKSKPFATDSGAMSHKLEKADLLKAIQEQLIANVHCNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAYDKDRYTEEEREVYSYLRYTGTPIPDNPNDK

SEQ ID NO: 357 - protein, 531 aa, Artificial Sequence
  Polypeptide construct
  MISC_FEATURE (1)..(531): Sequence representing single cysteine substitution mutant made on SEQ ID NO 22, wherein aspartate 212 is replaced by cysteine
VQAQQIVPIAEKCFDHAAGTSYVVGETWEKPYQGWMMVDCTCLGEGSGRITCTSRNRCNDQDSRTSYRIGDTWSKKDNRGNLLQCICTGNGRGEWKCERHTSVQTTSSGSGPFTDVRIAGPEWLLDRPSVNNSQLVVSVAGTVEGTNQDISLKFFEIDLTSRPAHGGKTEQGLSPKSKPFATDSGAMSHKLEKADLLKAIQEQLIANVHSNCDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAYDKDRYTEEEREVYSYLRYTGTPIPDNPNDK

SEQ ID NO: 358 - protein, 531 aa, Artificial Sequence
  Polypeptide construct
  MISC_FEATURE (1)..(531): Sequence representing single cysteine substitution mutant made on SEQ ID NO 22, wherein aspartate 213 is replaced by cysteine
VQAQQIVPIAEKCFDHAAGTSYVVGETWEKPYQGWMMVDCTCLGEGSGRITCTSRNRCNDQDSRTSYRIGDTWSKKDNRGNLLQCICTGNGRGEWKCERHTSVQTTSSGSGPFTDVRIAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDCYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAYDKDRYTEEEREVYSYLRYTGTPIPDNPNDK

SEQ ID NO: 359 - protein, 531 aa, Artificial Sequence
  Polypeptide construct
  MISC_FEATURE (1)..(531): Sequence representing single cysteine substitution mutant made on SEQ ID NO 22, wherein aspartate 219 is replaced by cysteine
VQAQQIVPIAEKCFDHAAGTSYVVGETWEKPYQGWMMVDCTCLGEGSGRITCTSRNRCNDQDSRTSYRIGDTWSKKDNRGNLLQCICTGNGRGEWKCERHTSVQTTSSGSGPFTDVRIAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVICFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAYDKDRYTEEEREVYSYLRYTGTPIPDNPNDK

SEQ ID NO: 360 - protein, 531 aa, Artificial Sequence
  Polypeptide construct
  MISC_FEATURE (1)..(531): Sequence representing single cysteine substitution mutant made on SEQ ID NO 22, wherein serine 222 is replaced by cysteine
VQAQQIVPIAEKCFDHAAGTSYVVGETWEKPYQGWMMVDCTCLGEGSGRITCTSRNRCNDQDSRTSYRIGDTWSKKDNRGNLLQCICTGNGRGEWKCERHTSVQTTSSGSGPFTDVRIAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFACDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAYDKDRYTEEEREVYSYLRYTGTPIPDNPNDK

SEQ ID NO: 361 - protein, 531 aa, Artificial Sequence
  Polypeptide construct
  MISC_FEATURE (1)..(531): Sequence representing single cysteine substitution mutant made on SEQ ID NO 22, wherein aspartate 237 is replaced by cysteine
VQAQQIVPIAEKCFDHAAGTSYVVGETWEKPYQGWMMVDCTCLGEGSGRITCTSRNRCNDQDSRTSYRIGDTWSKKDNRGNLLQCICTGNGRGEWKCERHTSVQTTSSGSGPFTDVRIAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFACKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAYDKDRYTEEEREVYSYLRYTGTPIPDNPNDK

SEQ ID NO: 362 - protein, 531 aa, Artificial Sequence
  Polypeptide construct
  MISC_FEATURE (1)..(531): Sequence representing single cysteine substitution mutant made on SEQ ID NO 22, wherein lysine 238 is replaced by cysteine
VQAQQIVPIAEKCFDHAAGTSYVVGETWEKPYQGWMMVDCTCLGEGSGRITCTSRNRCNDQDSRTSYRIGDTWSKKDNRGNLLQCICTGNGRGEWKCERHTSVQTTSSGSGPFTDVRIAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADCDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAYDKDRYTEEEREVYSYLRYTGTPIPDNPNDK

SEQ ID NO: 363 - protein, 531 aa, Artificial Sequence
  Polypeptide construct
  MISC_FEATURE (1)..(531): Sequence representing single cysteine substitution mutant made on SEQ ID NO 22, wherein aspartate 239 is replaced by cysteine
VQAQQIVPIAEKCFDHAAGTSYVVGETWEKPYQGWMMVDCTCLGEGSGRITCTSRNRCNDQDSRTSYRIGDTWSKKDNRGNLLQCICTGNGRGEWKCERHTSVQTTSSGSGPFTDVRIAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKCGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAYDKDRYTEEEREVYSYLRYTGTPIPDNPNDK

SEQ ID NO: 364 - protein, 531 aa, Artificial Sequence
  Polypeptide construct
  MISC_FEATURE (1)..(531): Sequence representing single cysteine substitution mutant made on SEQ ID NO 22, wherein glutamate 265 is replaced by cysteine
VQAQQIVPIAEKCFDHAAGTSYVVGETWEKPYQGWMMVDCTCLGEGSGRITCTSRNRCNDQDSRTSYRIGDTWSKKDNRGNLLQCICTGNGRGEWKCERHTSVQTTSSGSGPFTDVRIAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKCKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAYDKDRYTEEEREVYSYLRYTGTPIPDNPNDK

SEQ ID NO: 365 - protein, 531 aa, Artificial Sequence
  Polypeptide construct
  MISC_FEATURE (1)..(531): Sequence representing single cysteine substitution mutant made on SEQ ID NO 22, wherein lysine 273 is replaced by cysteine
VQAQQIVPIAEKCFDHAAGTSYVVGETWEKPYQGWMMVDCTCLGEGSGRITCTSRNRCNDQDSRTSYRIGDTWSKKDNRGNLLQCICTGNGRGEWKCERHTSVQTTSSGSGPFTDVRIAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQACSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAYDKDRYTEEEREVYSYLRYTGTPIPDNPNDK

SEQ ID NO: 366 - protein, 531 aa, Artificial Sequence
  Polypeptide construct
  MISC_FEATURE (1)..(531): Sequence representing single cysteine substitution mutant made on SEQ ID NO 22, wherein aspartate 290 is replaced by cysteine
VQAQQIVPIAEKCFDHAAGTSYVVGETWEKPYQGWMMVDCTCLGEGSGRITCTSRNRCNDQDSRTSYRIGDTWSKKDNRGNLLQCICTGNGRGEWKCERHTSVQTTSSGSGPFTDVRIAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDCDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAYDKDRYTEEEREVYSYLRYTGTPIPDNPNDK

SEQ ID NO: 367 - protein, 531 aa, Artificial Sequence
  Polypeptide construct
  MISC_FEATURE (1)..(531): Sequence representing single cysteine substitution mutant made on SEQ ID NO 22, wherein aspartate 291 is replaced by cysteine
VQAQQIVPIAEKCFDHAAGTSYVVGETWEKPYQGWMMVDCTCLGEGSGRITCTSRNRCNDQDSRTSYRIGDTWSKKDNRGNLLQCICTGNGRGEWKCERHTSVQTTSSGSGPFTDVRIAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDCFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAYDKDRYTEEEREVYSYLRYTGTPIPDNPNDK

SEQ ID NO: 368 - protein, 531 aa, Artificial Sequence
  Polypeptide construct
  MISC_FEATURE (1)..(531): Sequence representing single cysteine substitution mutant made on SEQ ID NO 22, wherein leucine 296 is replaced by cysteine
VQAQQIVPIAEKCFDHAAGTSYVVGETWEKPYQGWMMVDCTCLGEGSGRITCTSRNRCNDQDSRTSYRIGDTWSKKDNRGNLLQCICTGNGRGEWKCERHTSVQTTSSGSGPFTDVRIAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGCKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAYDKDRYTEEEREVYSYLRYTGTPIPDNPNDK

SEQ ID NO: 369 - protein, 531 aa, Artificial Sequence
  Polypeptide construct
  MISC_FEATURE (1)..(531): Sequence representing single cysteine substitution mutant made on SEQ ID NO 22, wherein aspartate 298 is replaced by cysteine
VQAQQIVPIAEKCFDHAAGTSYVVGETWEKPYQGWMMVDCTCLGEGSGRITCTSRNRCNDQDSRTSYRIGDTWSKKDNRGNLLQCICTGNGRGEWKCERHTSVQTTSSGSGPFTDVRIAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKCTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAYDKDRYTEEEREVYSYLRYTGTPIPDNPNDK

SEQ ID NO: 370 - protein, 531 aa, Artificial Sequence
  Polypeptide construct
  MISC_FEATURE (1)..(531): Sequence representing single cysteine substitution mutant made on SEQ ID NO 22, wherein serine 322 is replaced by cysteine
VQAQQIVPIAEKCFDHAAGTSYVVGETWEKPYQGWMMVDCTCLGEGSGRITCTSRNRCNDQDSRTSYRIGDTWSKKDNRGNLLQCICTGNGRGEWKCERHTSVQTTSSGSGPFTDVRIAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQCILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAYDKDRYTEEEREVYSYLRYTGTPIPDNPNDK

SEQ ID NO: 371 - protein, 531 aa, Artificial Sequence
  Polypeptide construct
  MISC_FEATURE (1)..(531): Sequence representing single cysteine substitution mutant made on SEQ ID NO 22, wherein isoleucine 371 is replaced by cysteine
VQAQQIVPIAEKCFDHAAGTSYVVGETWEKPYQGWMMVDCTCLGEGSGRITCTSRNRCNDQDSRTSYRIGDTWSKKDNRGNLLQCICTGNGRGEWKCERHTSVQTTSSGSGPFTDVRIAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRCNKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAYDKDRYTEEEREVYSYLRYTGTPIPDNPNDK

SEQ ID NO: 372 - protein, 531 aa, Artificial Sequence
  Polypeptide construct
  MISC_FEATURE (1)..(531): Sequence representing single cysteine substitution mutant made on SEQ ID NO 22, wherein asparagine 372 is replaced by cysteine
VQAQQIVPIAEKCFDHAAGTSYVVGETWEKPYQGWMMVDCTCLGEGSGRITCTSRNRCNDQDSRTSYRIGDTWSKKDNRGNLLQCICTGNGRGEWKCERHTSVQTTSSGSGPFTDVRIAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRICKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAYDKDRYTEEEREVYSYLRYTGTPIPDNPNDK

SEQ ID NO: 373 - protein, 531 aa, Artificial Sequence
  Polypeptide construct
  MISC_FEATURE (1)..(531): Sequence representing single cysteine substitution mutant made on SEQ ID NO 22, wherein lysine 373 is replaced by cysteine
VQAQQIVPIAEKCFDHAAGTSYVVGETWEKPYQGWMMVDCTCLGEGSGRITCTSRNRCNDQDSRTSYRIGDTWSKKDNRGNLLQCICTGNGRGEWKCERHTSVQTTSSGSGPFTDVRIAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINCKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAYDKDRYTEEEREVYSYLRYTGTPIPDNPNDK

SEQ ID NO: 374 - protein, 531 aa, Artificial Sequence
  Polypeptide construct
  MISC_FEATURE (1)..(531): Sequence representing single cysteine substitution mutant made on SEQ ID NO 22, wherein lysine 374 is replaced by cysteine
VQAQQIVPIAEKCFDHAAGTSYVVGETWEKPYQGWMMVDCTCLGEGSGRITCTSRNRCNDQDSRTSYRIGDTWSKKDNRGNLLQCICTGNGRGEWKCERHTSVQTTSSGSGPFTDVRIAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKCSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAYDKDRYTEEEREVYSYLRYTGTPIPDNPNDK

SEQ ID NO: 375 - protein, 531 aa, Artificial Sequence
  Polypeptide construct
  MISC_FEATURE (1)..(531): Sequence representing single cysteine substitution mutant made on SEQ ID NO 22, wherein serine 375 is replaced by cysteine
VQAQQIVPIAEKCFDHAAGTSYVVGETWEKPYQGWMMVDCTCLGEGSGRITCTSRNRCNDQDSRTSYRIGDTWSKKDNRGNLLQCICTGNGRGEWKCERHTSVQTTSSGSGPFTDVRIAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKCGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAYDKDRYTEEEREVYSYLRYTGTPIPDNPNDK

SEQ ID NO: 376 - protein, 531 aa, Artificial Sequence
  Polypeptide construct
  MISC_FEATURE (1)..(531): Sequence representing single cysteine substitution mutant made on SEQ ID NO 22, wherein leucine 377 is replaced by cysteine
VQAQQIVPIAEKCFDHAAGTSYVVGETWEKPYQGWMMVDCTCLGEGSGRITCTSRNRCNDQDSRTSYRIGDTWSKKDNRGNLLQCICTGNGRGEWKCERHTSVQTTSSGSGPFTDVRIAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGCNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAYDKDRYTEEEREVYSYLRYTGTPIPDNPNDK

SEQ ID NO: 377 - protein, 531 aa, Artificial Sequence
  Polypeptide construct
  MISC_FEATURE (1)..(531): Sequence representing single cysteine substitution mutant made on SEQ ID NO 22, wherein glutamate 398 is replaced by cysteine
VQAQQIVPIAEKCFDHAAGTSYVVGETWEKPYQGWMMVDCTCLGEGSGRITCTSRNRCNDQDSRTSYRIGDTWSKKDNRGNLLQCICTGNGRGEWKCERHTSVQTTSSGSGPFTDVRIAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGCKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAYDKDRYTEEEREVYSYLRYTGTPIPDNPNDK

SEQ ID NO: 378 - protein, 531 aa, Artificial Sequence
  Polypeptide construct
  MISC_FEATURE (1)..(531): Sequence representing single cysteine substitution mutant made on SEQ ID NO 22, wherein lysine 399 is replaced by cysteine
VQAQQIVPIAEKCFDHAAGTSYVVGETWEKPYQGWMMVDCTCLGEGSGRITCTSRNRCNDQDSRTSYRIGDTWSKKDNRGNLLQCICTGNGRGEWKCERHTSVQTTSSGSGPFTDVRIAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGECPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAYDKDRYTEEEREVYSYLRYTGTPIPDNPNDK

SEQ ID NO: 379 - protein, 531 aa, Artificial Sequence
  Polypeptide construct
  MISC_FEATURE (1)..(531): Sequence representing single cysteine substitution mutant made on SEQ ID NO 22, wherein phenyalanine 404 is replaced by cysteine
VQAQQIVPIAEKCFDHAAGTSYVVGETWEKPYQGWMMVDCTCLGEGSGRITCTSRNRCNDQDSRTSYRIGDTWSKKDNRGNLLQCICTGNGRGEWKCERHTSVQTTSSGSGPFTDVRIAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPCDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAYDKDRYTEEEREVYSYLRYTGTPIPDNPNDK

SEQ ID NO: 380 - protein, 531 aa, Artificial Sequence
  Polypeptide construct
  MISC_FEATURE (1)..(531): Sequence representing single cysteine substitution mutant made on SEQ ID NO 22, wherein aspartate 420 is replaced by cysteine
VQAQQIVPIAEKCFDHAAGTSYVVGETWEKPYQGWMMVDCTCLGEGSGRITCTSRNRCNDQDSRTSYRIGDTWSKKDNRGNLLQCICTGNGRGEWKCERHTSVQTTSSGSGPFTDVRIAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVCTNELLKSEQLLTASERNLDFRDLYDPRDKAKLLYNNLDAFGIMDYTLTGKVEDNHDDTNRIITVYMGKRPEGENASYHLAYDKDRYTEEEREVYSYLRYTGTPIPDNPNDK

SEQ ID NO: 381 - protein, 531 aa, Artificial Sequence
  Polypeptide construct
  MISC_FEATURE (1)..(531): Sequence representing single cysteine substitution mutant made on SEQ ID NO 22, wherein leucine 438 is replaced by cysteine
VQAQQIVPIAEKCFDHAAGTSYVVGETWEKPYQGWMMVDCTCLGEGSGRITCTSRNRCNDQDSRTSYRIGDTWSKKDNRGNLLQCICTGNGRGEWKCERHTSVQTTSSGSGPFTDVRIAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNCDFRDLYDPRDKAKLLYNNLDAFGIMDYTLTGKVEDNHDDTNRIITVYMGKRPEGENASYHLAYDKDRYTEEEREVYSYLRYTGTPIPDNPNDK

SEQ ID NO: 382 - protein, 531 aa, Artificial Sequence
  Polypeptide construct
  MISC_FEATURE (1)..(531): Sequence representing single cysteine substitution mutant made on SEQ ID NO 22, wherein leucine 443 is replaced by cysteine
VQAQQIVPIAEKCFDHAAGTSYVVGETWEKPYQGWMMVDCTCLGEGSGRITCTSRNRCNDQDSRTSYRIGDTWSKKDNRGNLLQCICTGNGRGEWKCERHTSVQTTSSGSGPFTDVRIAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDCYDPRDKAKLLYNNLDAFGIMDYTLTGKVEDNHDDTNRIITVYMGKRPEGENASYHLAYDKDRYTEEEREVYSYLRYTGTPIPDNPNDK

SEQ ID NO: 383 - protein, 531 aa, Artificial Sequence
  Polypeptide construct
  MISC_FEATURE (1)..(531): Sequence representing single cysteine substitution mutant made on SEQ ID NO 22, wherein alanine 450 is replaced by cysteine
VQAQQIVPIAEKCFDHAAGTSYVVGETWEKPYQGWMMVDCTCLGEGSGRITCTSRNRCNDQDSRTSYRIGDTWSKKDNRGNLLQCICTGNGRGEWKCERHTSVQTTSSGSGPFTDVRIAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKCKLLYNNLDAFGIMDYTLTGKVEDNHDDTNRIITVYMGKRPEGENASYHLAYDKDRYTEEEREVYSYLRYTGTPIPDNPNDK

SEQ ID NO: 384 - protein, 531 aa, Artificial Sequence
  Polypeptide construct
  MISC_FEATURE (1)..(531): Sequence representing single cysteine substitution mutant made on SEQ ID NO 22, wherein aspartate 464 is replaced by cysteine
VQAQQIVPIAEKCFDHAAGTSYVVGETWEKPYQGWMMVDCTCLGEGSGRITCTSRNRCNDQDSRTSYRIGDTWSKKDNRGNLLQCICTGNGRGEWKCERHTSVQTTSSGSGPFTDVRIAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMCYTLTGKVEDNHDDTNRIITVYMGKRPEGENASYHLAYDKDRYTEEEREVYSYLRYTGTPIPDNPNDK

SEQ ID NO: 385 - protein, 531 aa, Artificial Sequence
  Polypeptide construct
  MISC_FEATURE (1)..(531): Sequence representing single cysteine substitution mutant made on SEQ ID NO 22, wherein aspartate 477 is replaced by cysteine
VQAQQIVPIAEKCFDHAAGTSYVVGETWEKPYQGWMMVDCTCLGEGSGRITCTSRNRCNDQDSRTSYRIGDTWSKKDNRGNLLQCICTGNGRGEWKCERHTSVQTTSSGSGPFTDVRIAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDCTNRIITVYMGKRPEGENASYHLAYDKDRYTEEEREVYSYLRYTGTPIPDNPNDK

SEQ ID NO: 386 - protein, 531 aa, Artificial Sequence
  Polypeptide construct
  MISC_FEATURE (1)..(531): Sequence representing single cysteine substitution mutant made on SEQ ID NO 22, wherein arginine 489 is replaced by cysteine
VQAQQIVPIAEKCFDHAAGTSYVVGETWEKPYQGWMMVDCTCLGEGSGRITCTSRNRCNDQDSRTSYRIGDTWSKKDNRGNLLQCICTGNGRGEWKCERHTSVQTTSSGSGPFTDVRIAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKCPEGENASYHLAYDKDRYTEEEREVYSYLRYTGTPIPDNPNDK

SEQ ID NO: 387 - protein, 531 aa, Artificial Sequence
  Polypeptide construct
  MISC_FEATURE (1)..(531): Sequence representing double cysteine substitution mutant made on SEQ ID NO 22, wherein histidine 16 and isoleucine 205 are replaced by cysteine
VQAQQIVPIAEKCFDCAAGTSYVVGETWEKPYQGWMMVDCTCLGEGSGRITCTSRNRCNDQDSRTSYRIGDTWSKKDNRGNLLQCICTGNGRGEWKCERHTSVQTTSSGSGPFTDVRIAGPEWLLDRPSVNNSQLVVSVAGTVEGTNQDISLKFFEIDLTSRPAHGGKTEQGLSPKSKPFATDSGAMSHKLEKADLLKAIQEQLCANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAYDKDRYTEEEREVYSYLRYTGTPIPDNPNDK

SEQ ID NO: 388 - protein, 531 aa, Artificial Sequence
  Polypeptide construct
  MISC_FEATURE (1)..(531): Sequence representing double cysteine substitution mutant made on SEQ ID NO 22, wherein Histidine 16 and serine 322 are replaced by cysteine
VQAQQIVPIAEKCFDCAAGTSYVVGETWEKPYQGWMMVDCTCLGEGSGRITCTSRNRCNDQDSRTSYRIGDTWSKKDNRGNLLQCICTGNGRGEWKCERHTSVQTTSSGSGPFTDVRIAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQCILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAYDKDRYTEEEREVYSYLRYTGTPIPDNPNDK

SEQ ID NO: 389 - protein, 531 aa, Artificial Sequence
  Polypeptide construct
  MISC_FEATURE (1)..(531): Sequence representing double cysteine substitution mutant made on SEQ ID NO 22, wherein histidine 16 and leucine 377 are replaced by cysteine
VQAQQIVPIAEKCFDCAAGTSYVVGETWEKPYQGWMMVDCTCLGEGSGRITCTSRNRCNDQDSRTSYRIGDTWSKKDNRGNLLQCICTGNGRGEWKCERHTSVQTTSSGSGPFTDVRIAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGCNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAYDKDRYTEEEREVYSYLRYTGTPIPDNPNDK

SEQ ID NO: 390 - protein, 531 aa, Artificial Sequence
  Polypeptide construct
  MISC_FEATURE (1)..(531): Sequence representing double cysteine substitution mutant made on SEQ ID NO 22, wherein histidine 16 and arginine 489 are replaced by cysteine
VQAQQIVPIAEKCFDCAAGTSYVVGETWEKPYQGWMMVDCTCLGEGSGRITCTSRNRCNDQDSRTSYRIGDTWSKKDNRGNLLQCICTGNGRGEWKCERHTSVQTTSSGSGPFTDVRIAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKCPEGENASYHLAYDKDRYTEEEREVYSYLRYTGTPIPDNPNDK

SEQ ID NO: 391 - protein, 502 aa, Artificial Sequence
  Polypeptide construct
  MISC_FEATURE (1)..(502): Sequence representing single cysteine substitution mutant made on SEQ ID NO 23, wherein glycine 49 is replaced by cysteine
IAGPEWLLDRPSVNNSQLVVSVAGTVEGTNQDISLKFFEIDLTSRPAHCGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAGGGQAQQIVPIAEKCFDHAAGTSYLVGETWEKPYQGWMMVDCTCLGEGSGRITCTSRNRCNDQDTRTSYRIGDTWSKKDNRGNLLQCICTGNGRGEWKCERHTSVQTTSSGSGPFTDVR

SEQ ID NO: 392 - protein, 502 aa, Artificial Sequence
  Polypeptide construct
  MISC_FEATURE (1)..(502): Sequence representing single cysteine substitution mutant made on SEQ ID NO 23, wherein serine 57 is replaced by cysteine
IAGPEWLLDRPSVNNSQLVVSVAGTVEGTNQDISLKFFEIDLTSRPAHGGKTEQGLCPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAGGGQAQQIVPIAEKCFDHAAGTSYLVGETWEKPYQGWMMVDCTCLGEGSGRITCTSRNRCNDQDTRTSYRIGDTWSKKDNRGNLLQCICTGNGRGEWKCERHTSVQTTSSGSGPFTDVR

SEQ ID NO: 393 - protein, 414 aa, Artificial Sequence; identical to SEQ ID NO: 27
  Polypeptide construct
  MISC_FEATURE (1)..(414): Sequence representing single cysteine substitution mutant made on SEQ ID NO 23, wherein alanine 64 is replaced by cysteine

SEQ ID NO: 394 - protein, 502 aa, Artificial Sequence
  Polypeptide construct
  MISC_FEATURE (1)..(502): Sequence representing single cysteine substitution mutant made on SEQ ID NO 23, wherein Isoleucine 88 is replaced by cysteine
IAGPEWLLDRPSVNNSQLVVSVAGTVEGTNQDISLKFFEIDLTSRPAHGGKTEQGLSPKSKPFATDSGAMSHKLEKADLLKAIQEQLCANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAGGGQAQQIVPIAEKCFDHAAGTSYLVGETWEKPYQGWMMVDCTCLGEGSGRITCTSRNRCNDQDTRTSYRIGDTWSKKDNRGNLLQCICTGNGRGEWKCERHTSVQTTSSGSGPFTDVR

SEQ ID NO: 395 - protein, 502 aa, Artificial Sequence
  Polypeptide construct
  MISC_FEATURE (1)..(502): Sequence representing single cysteine substitution mutant made on SEQ ID NO 23, wherein serine 93 is replaced by cysteine
IAGPEWLLDRPSVNNSQLVVSVAGTVEGTNQDISLKFFEIDLTSRPAHGGKTEQGLSPKSKPFATDSGAMSHKLEKADLLKAIQEQLIANVHCNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAGGGQAQQIVPIAEKCFDHAAGTSYLVGETWEKPYQGWMMVDCTCLGEGSGRITCTSRNRCNDQDTRTSYRIGDTWSKKDNRGNLLQCICTGNGRGEWKCERHTSVQTTSSGSGPFTDVR

SEQ ID NO: 396 - protein, 502 aa, Artificial Sequence
  Polypeptide construct
  MISC_FEATURE (1)..(502): Sequence representing single cysteine substitution mutant made on SEQ ID NO 23, wherein aspartate 95 is replaced by cysteine
IAGPEWLLDRPSVNNSQLVVSVAGTVEGTNQDISLKFFEIDLTSRPAHGGKTEQGLSPKSKPFATDSGAMSHKLEKADLLKAIQEQLIANVHSNCDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAGGGQAQQIVPIAEKCFDHAAGTSYLVGETWEKPYQGWMMVDCTCLGEGSGRITCTSRNRCNDQDTRTSYRIGDTWSKKDNRGNLLQCICTGNGRGEWKCERHTSVQTTSSGSGPFTDVR

SEQ ID NO: 397 - protein, 502 aa, Artificial Sequence
  Polypeptide construct
  MISC_FEATURE (1)..(502): Sequence representing single cysteine substitution mutant made on SEQ ID NO 23, wherein aspartate 96 is replaced by cysteine
IAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDCYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAGGGQAQQIVPIAEKCFDHAAGTSYLVGETWEKPYQGWMMVDCTCLGEGSGRITCTSRNRCNDQDTRTSYRIGDTWSKKDNRGNLLQCICTGNGRGEWKCERHTSVQTTSSGSGPFTDVR

SEQ ID NO: 398 - protein, 502 aa, Artificial Sequence
  Polypeptide construct
  MISC_FEATURE (1)..(502): Sequence representing single cysteine substitution mutant made on SEQ ID NO 23, wherein aspartate 102 is replaced by cysteine
IAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVICFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAGGGQAQQIVPIAEKCFDHAAGTSYLVGETWEKPYQGWMMVDCTCLGEGSGRITCTSRNRCNDQDTRTSYRIGDTWSKKDNRGNLLQCICTGNGRGEWKCERHTSVQTTSSGSGPFTDVR

SEQ ID NO: 399 - protein, 502 aa, Artificial Sequence
  Polypeptide construct
  MISC_FEATURE (1)..(502): Sequence representing single cysteine substitution mutant made on SEQ ID NO 23, wherein serine 105 is replaced by cysteine
IAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFACDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAGGGQAQQIVPIAEKCFDHAAGTSYLVGETWEKPYQGWMMVDCTCLGEGSGRITCTSRNRCNDQDTRTSYRIGDTWSKKDNRGNLLQCICTGNGRGEWKCERHTSVQTTSSGSGPFTDVR

SEQ ID NO: 400 - protein, 502 aa, Artificial Sequence
  Polypeptide construct
  MISC_FEATURE (1)..(502): Sequence representing single cysteine substitution mutant made on SEQ ID NO 23, wherein aspartate  120 is replaced by cysteine
IAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFACKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAGGGQAQQIVPIAEKCFDHAAGTSYLVGETWEKPYQGWMMVDCTCLGEGSGRITCTSRNRCNDQDTRTSYRIGDTWSKKDNRGNLLQCICTGNGRGEWKCERHTSVQTTSSGSGPFTDVR

SEQ ID NO: 401 - protein, 502 aa, Artificial Sequence
  Polypeptide construct
  MISC_FEATURE (1)..(502): Sequence representing single cysteine substitution mutant made on SEQ ID NO 23, wherein lysine 121 is replaced by cysteine
IAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADCDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAGGGQAQQIVPIAEKCFDHAAGTSYLVGETWEKPYQGWMMVDCTCLGEGSGRITCTSRNRCNDQDTRTSYRIGDTWSKKDNRGNLLQCICTGNGRGEWKCERHTSVQTTSSGSGPFTDVR

SEQ ID NO: 402 - protein, 502 aa, Artificial Sequence
  Polypeptide construct
  MISC_FEATURE (1)..(502): Sequence representing single cysteine substitution mutant made on SEQ ID NO 23, wherein aspartate 122 is replaced by cysteine
IAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKCGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAGGGQAQQIVPIAEKCFDHAAGTSYLVGETWEKPYQGWMMVDCTCLGEGSGRITCTSRNRCNDQDTRTSYRIGDTWSKKDNRGNLLQCICTGNGRGEWKCERHTSVQTTSSGSGPFTDVR

SEQ ID NO: 403 - protein, 502 aa, Artificial Sequence
  Polypeptide construct
  MISC_FEATURE (1)..(502): Sequence representing single cysteine substitution mutant made on SEQ ID NO 23, wherein glutamate 148 is replaced by cysteine
IAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKCKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAGGGQAQQIVPIAEKCFDHAAGTSYLVGETWEKPYQGWMMVDCTCLGEGSGRITCTSRNRCNDQDTRTSYRIGDTWSKKDNRGNLLQCICTGNGRGEWKCERHTSVQTTSSGSGPFTDVR

SEQ ID NO: 404 - protein, 502 aa, Artificial Sequence
  Polypeptide construct
  MISC_FEATURE (1)..(502): Sequence representing single cysteine substitution mutant made on SEQ ID NO 23, wherein lysine 156 is replaced by cysteine
IAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQACSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAGGGQAQQIVPIAEKCFDHAAGTSYLVGETWEKPYQGWMMVDCTCLGEGSGRITCTSRNRCNDQDTRTSYRIGDTWSKKDNRGNLLQCICTGNGRGEWKCERHTSVQTTSSGSGPFTDVR

SEQ ID NO: 405 - protein, 502 aa, Artificial Sequence
  Polypeptide construct
  MISC_FEATURE (1)..(502): Sequence representing single cysteine substitution mutant made on SEQ ID NO 23, wherein aspartate  173 is replaced by cysteine
IAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDCDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAGGGQAQQIVPIAEKCFDHAAGTSYLVGETWEKPYQGWMMVDCTCLGEGSGRITCTSRNRCNDQDTRTSYRIGDTWSKKDNRGNLLQCICTGNGRGEWKCERHTSVQTTSSGSGPFTDVR

SEQ ID NO: 406 - protein, 502 aa, Artificial Sequence
  Polypeptide construct
  MISC_FEATURE (1)..(502): Sequence representing single cysteine substitution mutant made on SEQ ID NO 23, wherein aspartate  174 is replaced by cysteine
IAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDCFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAGGGQAQQIVPIAEKCFDHAAGTSYLVGETWEKPYQGWMMVDCTCLGEGSGRITCTSRNRCNDQDTRTSYRIGDTWSKKDNRGNLLQCICTGNGRGEWKCERHTSVQTTSSGSGPFTDVR

SEQ ID NO: 407 - protein, 502 aa, Artificial Sequence
  Polypeptide construct
  MISC_FEATURE (1)..(502): Sequence representing single cysteine substitution mutant made on SEQ ID NO 23, wherein leucine  179 is replaced by cysteine
IAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGCKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAGGGQAQQIVPIAEKCFDHAAGTSYLVGETWEKPYQGWMMVDCTCLGEGSGRITCTSRNRCNDQDTRTSYRIGDTWSKKDNRGNLLQCICTGNGRGEWKCERHTSVQTTSSGSGPFTDVR

SEQ ID NO: 408 - protein, 502 aa, Artificial Sequence
  Polypeptide construct
  MISC_FEATURE (1)..(502): Sequence representing single cysteine substitution mutant made on SEQ ID NO 23, wherein aspartate  181 is replaced by cysteine
IAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKCTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAGGGQAQQIVPIAEKCFDHAAGTSYLVGETWEKPYQGWMMVDCTCLGEGSGRITCTSRNRCNDQDTRTSYRIGDTWSKKDNRGNLLQCICTGNGRGEWKCERHTSVQTTSSGSGPFTDVR

SEQ ID NO: 409 - protein, 502 aa, Artificial Sequence
  Polypeptide construct
  MISC_FEATURE (1)..(502): Sequence representing single cysteine substitution mutant made on SEQ ID NO 23, wherein serine 205 is replaced by cysteine
IAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQCILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAGGGQAQQIVPIAEKCFDHAAGTSYLVGETWEKPYQGWMMVDCTCLGEGSGRITCTSRNRCNDQDTRTSYRIGDTWSKKDNRGNLLQCICTGNGRGEWKCERHTSVQTTSSGSGPFTDVR

SEQ ID NO: 410 - protein, 502 aa, Artificial Sequence
  Polypeptide construct
  MISC_FEATURE (1)..(502): Sequence representing single cysteine substitution mutant made on SEQ ID NO 23, wherein alanine 251 is replaced by cysteine
IAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQCYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAGGGQAQQIVPIAEKCFDHAAGTSYLVGETWEKPYQGWMMVDCTCLGEGSGRITCTSRNRCNDQDTRTSYRIGDTWSKKDNRGNLLQCICTGNGRGEWKCERHTSVQTTSSGSGPFTDVR

SEQ ID NO: 411 - protein, 502 aa, Artificial Sequence
  Polypeptide construct
  MISC_FEATURE (1)..(502): Sequence representing single cysteine substitution mutant made on SEQ ID NO 23, wherein isoleucine 254 is replaced by cysteine
IAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRCNKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAGGGQAQQIVPIAEKCFDHAAGTSYLVGETWEKPYQGWMMVDCTCLGEGSGRITCTSRNRCNDQDTRTSYRIGDTWSKKDNRGNLLQCICTGNGRGEWKCERHTSVQTTSSGSGPFTDVR

SEQ ID NO: 412 - protein, 502 aa, Artificial Sequence
  Polypeptide construct
  MISC_FEATURE (1)..(502): Sequence representing single cysteine substitution mutant made on SEQ ID NO 23, wherein asparagine 255 is replaced by cysteine
IAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRICKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAGGGQAQQIVPIAEKCFDHAAGTSYLVGETWEKPYQGWMMVDCTCLGEGSGRITCTSRNRCNDQDTRTSYRIGDTWSKKDNRGNLLQCICTGNGRGEWKCERHTSVQTTSSGSGPFTDVR

SEQ ID NO: 413 - protein, 502 aa, Artificial Sequence
  Polypeptide construct
  MISC_FEATURE (1)..(502): Sequence representing single cysteine substitution mutant made on SEQ ID NO 23, wherein lysine 256 is replaced by cysteine
IAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINCKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAGGGQAQQIVPIAEKCFDHAAGTSYLVGETWEKPYQGWMMVDCTCLGEGSGRITCTSRNRCNDQDTRTSYRIGDTWSKKDNRGNLLQCICTGNGRGEWKCERHTSVQTTSSGSGPFTDVR

SEQ ID NO: 414 - protein, 502 aa, Artificial Sequence
  Polypeptide construct
  MISC_FEATURE (1)..(502): Sequence representing single cysteine substitution mutant made on SEQ ID NO 23, wherein lysine 257 is replaced by cysteine
IAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKCSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAGGGQAQQIVPIAEKCFDHAAGTSYLVGETWEKPYQGWMMVDCTCLGEGSGRITCTSRNRCNDQDTRTSYRIGDTWSKKDNRGNLLQCICTGNGRGEWKCERHTSVQTTSSGSGPFTDVR

SEQ ID NO: 415 - protein, 502 aa, Artificial Sequence
  Polypeptide construct
  MISC_FEATURE (1)..(502): Sequence representing single cysteine substitution mutant made on SEQ ID NO 23, wherein serine 258 is replaced by cysteine
IAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKCGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAGGGQAQQIVPIAEKCFDHAAGTSYLVGETWEKPYQGWMMVDCTCLGEGSGRITCTSRNRCNDQDTRTSYRIGDTWSKKDNRGNLLQCICTGNGRGEWKCERHTSVQTTSSGSGPFTDVR

SEQ ID NO: 416 - protein, 502 aa, Artificial Sequence
  Polypeptide construct
  MISC_FEATURE (1)..(502): Sequence representing single cysteine substitution mutant made on SEQ ID NO 23, wherein leucine 260 is replaced by cysteine
IAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGCNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAGGGQAQQIVPIAEKCFDHAAGTSYLVGETWEKPYQGWMMVDCTCLGEGSGRITCTSRNRCNDQDTRTSYRIGDTWSKKDNRGNLLQCICTGNGRGEWKCERHTSVQTTSSGSGPFTDVR

SEQ ID NO: 417 - protein, 502 aa, Artificial Sequence
  Polypeptide construct
  MISC_FEATURE (1)..(502): Sequence representing single cysteine substitution mutant made on SEQ ID NO 23, wherein glutamate 281 is replaced by cysteine
IAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGCKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAGGGQAQQIVPIAEKCFDHAAGTSYLVGETWEKPYQGWMMVDCTCLGEGSGRITCTSRNRCNDQDTRTSYRIGDTWSKKDNRGNLLQCICTGNGRGEWKCERHTSVQTTSSGSGPFTDVR

SEQ ID NO: 418 - protein, 502 aa, Artificial Sequence
  Polypeptide construct
  MISC_FEATURE (1)..(502): Sequence representing single cysteine substitution mutant made on SEQ ID NO 23, wherein lysine 282 is replaced by cysteine
IAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGECPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAGGGQAQQIVPIAEKCFDHAAGTSYLVGETWEKPYQGWMMVDCTCLGEGSGRITCTSRNRCNDQDTRTSYRIGDTWSKKDNRGNLLQCICTGNGRGEWKCERHTSVQTTSSGSGPFTDVR

SEQ ID NO: 419 - protein, 502 aa, Artificial Sequence
  Polypeptide construct
  MISC_FEATURE (1)..(502): Sequence representing single cysteine substitution mutant made on SEQ ID NO 23, wherein phenyalanine 287 is replaced by cysteine
IAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPCDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAGGGQAQQIVPIAEKCFDHAAGTSYLVGETWEKPYQGWMMVDCTCLGEGSGRITCTSRNRCNDQDTRTSYRIGDTWSKKDNRGNLLQCICTGNGRGEWKCERHTSVQTTSSGSGPFTDVR

SEQ ID NO: 420 - protein, 502 aa, Artificial Sequence
  Polypeptide construct
  MISC_FEATURE (1)..(502): Sequence representing single cysteine substitution mutant made on SEQ ID NO 23, wherein aspartate 303 is replaced by cysteine
IAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVCTNELLKSEQLLTASERNLDFRDLYDPRDKAKLLYNNLDAFGIMDYTLTGKVEDNHDDTNRIITVYMGKRPEGENASYHLAGGGQAQQIVPIAEKCFDHAAGTSYLVGETWEKPYQGWMMVDCTCLGEGSGRITCTSRNRCNDQDTRTSYRIGDTWSKKDNRGNLLQCICTGNGRGEWKCERHTSVQTTSSGSGPFTDVR

SEQ ID NO: 421 - protein, 502 aa, Artificial Sequence
  Polypeptide construct
  MISC_FEATURE (1)..(502): Sequence representing single cysteine substitution mutant made on SEQ ID NO 23, wherein leucine  321 is replaced by cysteine
IAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNCDFRDLYDPRDKAKLLYNNLDAFGIMDYTLTGKVEDNHDDTNRIITVYMGKRPEGENASYHLAGGGQAQQIVPIAEKCFDHAAGTSYLVGETWEKPYQGWMMVDCTCLGEGSGRITCTSRNRCNDQDTRTSYRIGDTWSKKDNRGNLLQCICTGNGRGEWKCERHTSVQTTSSGSGPFTDVR

SEQ ID NO: 422 - protein, 502 aa, Artificial Sequence
  Polypeptide construct
  MISC_FEATURE (1)..(502): Sequence representing single cysteine substitution mutant made on SEQ ID NO 23, wherein leucine 326 is replaced by cysteine
IAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDCYDPRDKAKLLYNNLDAFGIMDYTLTGKVEDNHDDTNRIITVYMGKRPEGENASYHLAGGGQAQQIVPIAEKCFDHAAGTSYLVGETWEKPYQGWMMVDCTCLGEGSGRITCTSRNRCNDQDTRTSYRIGDTWSKKDNRGNLLQCICTGNGRGEWKCERHTSVQTTSSGSGPFTDVR

SEQ ID NO: 423 - protein, 502 aa, Artificial Sequence
  Polypeptide construct
  MISC_FEATURE (1)..(502): Sequence representing single cysteine substitution mutant made on SEQ ID NO 23, wherein alanine 333 is replaced by cysteine
IAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKCKLLYNNLDAFGIMDYTLTGKVEDNHDDTNRIITVYMGKRPEGENASYHLAGGGQAQQIVPIAEKCFDHAAGTSYLVGETWEKPYQGWMMVDCTCLGEGSGRITCTSRNRCNDQDTRTSYRIGDTWSKKDNRGNLLQCICTGNGRGEWKCERHTSVQTTSSGSGPFTDVR

SEQ ID NO: 424 - protein, 502 aa, Artificial Sequence
  Polypeptide construct
  MISC_FEATURE (1)..(502): Sequence representing single cysteine substitution mutant made on SEQ ID NO 23, wherein aspartate 347 is replaced by cysteine
IAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDCYDPRDKAKLLYNNLDAFGIMCYTLTGKVEDNHDDTNRIITVYMGKRPEGENASYHLAGGGQAQQIVPIAEKCFDHAAGTSYLVGETWEKPYQGWMMVDCTCLGEGSGRITCTSRNRCNDQDTRTSYRIGDTWSKKDNRGNLLQCICTGNGRGEWKCERHTSVQTTSSGSGPFTDVR

SEQ ID NO: 425 - protein, 502 aa, Artificial Sequence
  Polypeptide construct
  MISC_FEATURE (1)..(502): Sequence representing single cysteine substitution mutant made on SEQ ID NO 23, wherein aspartate 360 is replaced by cysteine
IAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDCTNRIITVYMGKRPEGENASYHLAGGGQAQQIVPIAEKCFDHAAGTSYLVGETWEKPYQGWMMVDCTCLGEGSGRITCTSRNRCNDQDTRTSYRIGDTWSKKDNRGNLLQCICTGNGRGEWKCERHTSVQTTSSGSGPFTDVR

SEQ ID NO: 426 - protein, 502 aa, Artificial Sequence
  Polypeptide construct
  MISC_FEATURE (1)..(502): Sequence representing single cysteine substitution mutant made on SEQ ID NO 23, wherein arginine 372 is replaced by cysteine
IAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKCPEGENASYHLAGGGQAQQIVPIAEKCFDHAAGTSYLVGETWEKPYQGWMMVDCTCLGEGSGRITCTSRNRCNDQDTRTSYRIGDTWSKKDNRGNLLQCICTGNGRGEWKCERHTSVQTTSSGSGPFTDVR

SEQ ID NO: 427 - protein, 502 aa, Artificial Sequence
  Polypeptide construct
  MISC_FEATURE (1)..(502): Sequence representing single cysteine substitution mutant made on SEQ ID NO 23, wherein histidine 401 is replaced by cysteine
IAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDPNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQELSYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAGGGQAQQIVPIAEKCFDCAAGTSYLVGETWEKPYQGWMMVDCTCLGEGSGRITCTSRNRCNDQDTRTSYRIGDTWSKKDNRGNLLQCICTGNGRGEWKCERHTSVQTTSSGSGPFTDVR

SEQ ID NO: 428 - protein, 502 aa, Artificial Sequence
  Polypeptide construct
  MISC_FEATURE (1)..(502): Sequence representing single cysteine substitution mutant made on SEQ ID NO 23, wherein alanine 402 is replaced by cysteine
IAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDPNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQELSYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAGGGQAQQIVPIAEKCFDHCAGTSYLVGETWEKPYQGWMMVDCTCLGEGSGRITCTSRNRCNDQDTRTSYRIGDTWSKKDNRGNLLQCICTGNGRGEWKCERHTSVQTTSSGSGPFTDVR

SEQ ID NO: 429 - protein, 502 aa, Artificial Sequence
  Polypeptide construct
  MISC_FEATURE (1)..(502): Sequence representing single cysteine substitution mutant made on SEQ ID NO 23, wherein aspartate 447 is replaced by cysteine
IAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDPNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQELSYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAGGGQAQQIVPIAEKCFDHAAGTSYLVGETWEKPYQGWMMVDCTCLGEGSGRITCTSRNRCNDQCTRTSYRIGDTWSKKDNRGNLLQCICTGNGRGEWKCERHTSVQTTSSGSGPFTDVR

SEQ ID NO: 430 - protein, 502 aa, Artificial Sequence
  Polypeptide construct
  MISC_FEATURE (1)..(502): Sequence representing single cysteine substitution mutant made on SEQ ID NO 23, wherein glycine 465 is replaced by cysteine
IAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDPNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQELSYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAGGGQAQQIVPIAEKCFDHAAGTSYLVGETWEKPYQGWMMVDCTCLGEGSGRITCTSRNRCNDQDTRTSYRIGDTWSKKDNRCNLLQCICTGNGRGEWKCERHTSVQTTSSGSGPFTDVR

SEQ ID NO: 431 - protein, 502 aa, Artificial Sequence
  Polypeptide construct
  MISC_FEATURE (1)..(502): Sequence representing double cysteine substitution mutant made on SED ID NO 23, where isoleucine 88 and histidine 401 are replaced by cysteine
IAGPEWLLDRPSVNNSQLVVSVAGTVEGTNQDISLKFFEIDLTSRPAHGGKTEQGLSPKSKPFATDSGAMSHKLEKADLLKAIQEQLCANVHSNDDYFEVIDFASDATITDPNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQELSYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAGGGQAQQIVPIAEKCFDCAAGTSYLVGETWEKPYQGWMMVDCTCLGEGSGRITCTSRNRCNDQDTRTSYRIGDTWSKKDNRGNLLQCICTGNGRGEWKCERHTSVQTTSSGSGPFTDVR

SEQ ID NO: 432 - protein, 502 aa, Artificial Sequence
  Polypeptide construct
  MISC_FEATURE (1)..(502): Sequence representing double cysteine substitution mutant made on SED ID NO 23, where serine 205 and histidine 401 are replaced by cysteine
IAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDPNGKVYFADKDGSVTLPTQPVQEFLLSGHVRVRPYKEKPIQNQAKSVDVEYTVQFTPLNPDDDFRPGLKDTKLLKTLAIGDTITSQELLAQAQCILNKNHPGYTIYERDSSIVTHDNDIFRTILPMDQELSYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAGGGQAQQIVPIAEKCFDCAAGTSYLVGETWEKPYQGWMMVDCTCLGEGSGRITCTSRNRCNDQDTRTSYRIGDTWSKKDNRGNLLQCICTGNGRGEWKCERHTSVQTTSSGSGPFTDVR

SEQ ID NO: 433 - protein, 502 aa, Artificial Sequence
  Polypeptide construct
  MISC_FEATURE (1)..(502): Sequence representing double cysteine substitution mutant made on SED ID NO 23, where leucine 260 histidine 401 are replaced by cysteine
IAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDPNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQELSYRVKNREQAYRINKKSGCNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAGGGQAQQIVPIAEKCFDCAAGTSYLVGETWEKPYQGWMMVDCTCLGEGSGRITCTSRNRCNDQDTRTSYRIGDTWSKKDNRGNLLQCICTGNGRGEWKCERHTSVQTTSSGSGPFTDVR

SEQ ID NO: 434 - protein, 502 aa, Artificial Sequence
  Polypeptide construct
  MISC_FEATURE (1)..(502): Sequence representing double cysteine substitution mutant made on SED ID NO 23, where arginine 372 histidine 401 are replaced by cysteine
IAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKCPEGENASYHLAGGGQAQQIVPIAEKCFDCAAGTSYLVGETWEKPYQGWMMVDCTCLGEGSGRITCTSRNRCNDQDTRTSYRIGDTWSKKDNRGNLLQCICTGNGRGEWKCERHTSVQTTSSGSGPFTDVR

SEQ ID NO: 435 - protein, 619 aa, Artificial Sequence
  Polypeptide construct
  MISC_FEATURE (1)..(619): Sequence representing single cysteine substitution mutant made on SEQ ID NO 24, wherein histidine 16 is replaced by cysteine
VQAQQIVPIAEKCFDCAAGTSYLVGETWEKPYQGWMMVDCTCLGEGSGRITCTSRNRCNDQDTRTSYRIGDTWSKKDNRGNLLQCICTGNGRGEWKCERHTSVQTTSSGSGPFTDVRIAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDPNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQELSYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAGGGQAQQIVPIAEKCFDHAAGTSYLVGETWEKPYQGWMMVDCTCLGEGSGRITCTSRNRCNDQDTRTSYRIGDTWSKKDNRGNLLQCICTGNGRGEWKCERHTSVQTTSSGSGPFTDVR

SEQ ID NO: 436 - protein, 619 aa, Artificial Sequence
  Polypeptide construct
  MISC_FEATURE (1)..(619): Sequence representing single cysteine substitution mutant made on SEQ ID NO 24, wherein alanine 17 is replaced by cysteine
VQAQQIVPIAEKCFDHCAGTSYLVGETWEKPYQGWMMVDCTCLGEGSGRITCTSRNRCNDQDTRTSYRIGDTWSKKDNRGNLLQCICTGNGRGEWKCERHTSVQTTSSGSGPFTDVRIAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDPNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQELSYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAGGGQAQQIVPIAEKCFDHAAGTSYLVGETWEKPYQGWMMVDCTCLGEGSGRITCTSRNRCNDQDTRTSYRIGDTWSKKDNRGNLLQCICTGNGRGEWKCERHTSVQTTSSGSGPFTDVR

SEQ ID NO: 437 - protein, 619 aa, Artificial Sequence
  Polypeptide construct
  MISC_FEATURE (1)..(619): Sequence representing single cysteine substitution mutant made on SEQ ID NO 24, wherein aspartate 62 is replaced by cysteine
VQAQQIVPIAEKCFDHAAGTSYLVGETWEKPYQGWMMVDCTCLGEGSGRITCTSRNRCNDQCTRTSYRIGDTWSKKDNRGNLLQCICTGNGRGEWKCERHTSVQTTSSGSGPFTDVRIAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDPNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQELSYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAGGGQAQQIVPIAEKCFDHAAGTSYLVGETWEKPYQGWMMVDCTCLGEGSGRITCTSRNRCNDQDTRTSYRIGDTWSKKDNRGNLLQCICTGNGRGEWKCERHTSVQTTSSGSGPFTDVR

SEQ ID NO: 438 - protein, 619 aa, Artificial Sequence
  Polypeptide construct
  MISC_FEATURE (1)..(619): Sequence representing single cysteine substitution mutant made on SEQ ID NO 24, wherein glycine 80 is replaced by cysteine
VQAQQIVPIAEKCFDHAAGTSYLVGETWEKPYQGWMMVDCTCLGEGSGRITCTSRNRCNDQDTRTSYRIGDTWSKKDNRCNLLQCICTGNGRGEWKCERHTSVQTTSSGSGPFTDVRIAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDPNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQELSYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAGGGQAQQIVPIAEKCFDHAAGTSYLVGETWEKPYQGWMMVDCTCLGEGSGRITCTSRNRCNDQDTRTSYRIGDTWSKKDNRGNLLQCICTGNGRGEWKCERHTSVQTTSSGSGPFTDVR

SEQ ID NO: 439 - protein, 619 aa, Artificial Sequence
  Polypeptide construct
  MISC_FEATURE (1)..(619): Sequence representing single cysteine substitution mutant made on SEQ ID NO 24, wherein glycine 166 is replaced by cysteine
VQAQQIVPIAEKCFDHAAGTSYLVGETWEKPYQGWMMVDCTCLGEGSGRITCTSRNRCNDQDTRTSYRIGDTWSKKDNRGNLLQCICTGNGRGEWKCERHTSVQTTSSGSGPFTDVRIAGPEWLLDRPSVNNSQLVVSVAGTVEGTNQDISLKFFEIDLTSRPAHCGKTEQGLSPKSKPFATDSGAMSHKLEKADLLKAIQEQLIANVHSNDDYFEVIDFASDATITDPNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQELSYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAGGGQAQQIVPIAEKCFDHAAGTSYLVGETWEKPYQGWMMVDCTCLGEGSGRITCTSRNRCNDQDTRTSYRIGDTWSKKDNRGNLLQCICTGNGRGEWKCERHTSVQTTSSGSGPFTDVR

SEQ ID NO: 440 - protein, 619 aa, Artificial Sequence
  Polypeptide construct
  MISC_FEATURE (1)..(619): Sequence representing single cysteine substitution mutant made on SEQ ID NO 24, wherein serine 174 is replaced by cysteine
VQAQQIVPIAEKCFDHAAGTSYLVGETWEKPYQGWMMVDCTCLGEGSGRITCTSRNRCNDQDTRTSYRIGDTWSKKDNRGNLLQCICTGNGRGEWKCERHTSVQTTSSGSGPFTDVRIAGPEWLLDRPSVNNSQLVVSVAGTVEGTNQDISLKFFEIDLTSRPAHGGKTEQGLCPKSKPFATDSGAMSHKLEKADLLKAIQEQLIANVHSNDDYFEVIDFASDATITDPNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQELSYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAGGGQAQQIVPIAEKCFDHAAGTSYLVGETWEKPYQGWMMVDCTCLGEGSGRITCTSRNRCNDQDTRTSYRIGDTWSKKDNRGNLLQCICTGNGRGEWKCERHTSVQTTSSGSGPFTDVR

SEQ ID NO: 441 - protein, 619 aa, Artificial Sequence
  Polypeptide construct
  MISC_FEATURE (1)..(619): Sequence representing single cysteine substitution mutant made on SEQ ID NO 24, wherein alanine 181 is replaced by cysteine
VQAQQIVPIAEKCFDHAAGTSYLVGETWEKPYQGWMMVDCTCLGEGSGRITCTSRNRCNDQDTRTSYRIGDTWSKKDNRGNLLQCICTGNGRGEWKCERHTSVQTTSSGSGPFTDVRIAGPEWLLDRPSVNNSQLVVSVAGTVEGTNQDISLKFFEIDLTSRPAHGGKTEQGLSPKSKPFCTDSGAMSHKLEKADLLKAIQEQLIANVHSNDDYFEVIDFASDATITDPNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQELSYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAGGGQAQQIVPIAEKCFDHAAGTSYLVGETWEKPYQGWMMVDCTCLGEGSGRITCTSRNRCNDQDTRTSYRIGDTWSKKDNRGNLLQCICTGNGRGEWKCERHTSVQTTSSGSGPFTDVR

SEQ ID NO: 442 - protein, 619 aa, Artificial Sequence
  Polypeptide construct
  MISC_FEATURE (1)..(619): Sequence representing single cysteine substitution mutant made on SEQ ID NO 24, wherein isoleucine 205 is replaced by cysteine
VQAQQIVPIAEKCFDHAAGTSYLVGETWEKPYQGWMMVDCTCLGEGSGRITCTSRNRCNDQDTRTSYRIGDTWSKKDNRGNLLQCICTGNGRGEWKCERHTSVQTTSSGSGPFTDVRIAGPEWLLDRPSVNNSQLVVSVAGTVEGTNQDISLKFFEIDLTSRPAHGGKTEQGLSPKSKPFATDSGAMSHKLEKADLLKAIQEQLCANVHSNDDYFEVIDFASDATITDPNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQELSYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAGGGQAQQIVPIAEKCFDHAAGTSYLVGETWEKPYQGWMMVDCTCLGEGSGRITCTSRNRCNDQDTRTSYRIGDTWSKKDNRGNLLQCICTGNGRGEWKCERHTSVQTTSSGSGPFTDVR

SEQ ID NO: 443 - protein, 619 aa, Artificial Sequence
  Polypeptide construct
  MISC_FEATURE (1)..(619): Sequence representing single cysteine substitution mutant made on SEQ ID NO 24, wherein serine 210 is replaced by cysteine
VQAQQIVPIAEKCFDHAAGTSYLVGETWEKPYQGWMMVDCTCLGEGSGRITCTSRNRCNDQDTRTSYRIGDTWSKKDNRGNLLQCICTGNGRGEWKCERHTSVQTTSSGSGPFTDVRIAGPEWLLDRPSVNNSQLVVSVAGTVEGTNQDISLKFFEIDLTSRPAHGGKTEQGLSPKSKPFATDSGAMSHKLEKADLLKAIQEQLIANVHCNDDYFEVIDFASDATITDPNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQELSYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAGGGQAQQIVPIAEKCFDHAAGTSYLVGETWEKPYQGWMMVDCTCLGEGSGRITCTSRNRCNDQDTRTSYRIGDTWSKKDNRGNLLQCICTGNGRGEWKCERHTSVQTTSSGSGPFTDVR

SEQ ID NO: 444 - protein, 619 aa, Artificial Sequence
  Polypeptide construct
  MISC_FEATURE (1)..(619): Sequence representing single cysteine substitution mutant made on SEQ ID NO 24, wherein aspartate 212 is replaced by cysteine
VQAQQIVPIAEKCFDHAAGTSYLVGETWEKPYQGWMMVDCTCLGEGSGRITCTSRNRCNDQDTRTSYRIGDTWSKKDNRGNLLQCICTGNGRGEWKCERHTSVQTTSSGSGPFTDVRIAGPEWLLDRPSVNNSQLVVSVAGTVEGTNQDISLKFFEIDLTSRPAHGGKTEQGLSPKSKPFATDSGAMSHKLEKADLLKAIQEQLIANVHSNCDYFEVIDFASDATITDPNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQELSYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAGGGQAQQIVPIAEKCFDHAAGTSYLVGETWEKPYQGWMMVDCTCLGEGSGRITCTSRNRCNDQDTRTSYRIGDTWSKKDNRGNLLQCICTGNGRGEWKCERHTSVQTTSSGSGPFTDVR

SEQ ID NO: 445 - protein, 619 aa, Artificial Sequence
  Polypeptide construct
  MISC_FEATURE (1)..(619): Sequence representing single cysteine substitution mutant made on SEQ ID NO 24, wherein aspartate 213 is replaced by cysteine
VQAQQIVPIAEKCFDHAAGTSYLVGETWEKPYQGWMMVDCTCLGEGSGRITCTSRNRCNDQDTRTSYRIGDTWSKKDNRGNLLQCICTGNGRGEWKCERHTSVQTTSSGSGPFTDVRIAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDCYFEVIDFASDATITDPNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQELSYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAGGGQAQQIVPIAEKCFDHAAGTSYLVGETWEKPYQGWMMVDCTCLGEGSGRITCTSRNRCNDQDTRTSYRIGDTWSKKDNRGNLLQCICTGNGRGEWKCERHTSVQTTSSGSGPFTDVR

SEQ ID NO: 446 - protein, 619 aa, Artificial Sequence
  Polypeptide construct
  MISC_FEATURE (1)..(619): Sequence representing single cysteine substitution mutant made on SEQ ID NO 24, wherein aspartate 219 is replaced by cysteine
VQAQQIVPIAEKCFDHAAGTSYLVGETWEKPYQGWMMVDCTCLGEGSGRITCTSRNRCNDQDTRTSYRIGDTWSKKDNRGNLLQCICTGNGRGEWKCERHTSVQTTSSGSGPFTDVRIAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVICFASDATITDPNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQELSYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAGGGQAQQIVPIAEKCFDHAAGTSYLVGETWEKPYQGWMMVDCTCLGEGSGRITCTSRNRCNDQDTRTSYRIGDTWSKKDNRGNLLQCICTGNGRGEWKCERHTSVQTTSSGSGPFTDVR

SEQ ID NO: 447 - protein, 619 aa, Artificial Sequence
  Polypeptide construct
  MISC_FEATURE (1)..(619): Sequence representing single cysteine substitution mutant made on SEQ ID NO 24, wherein serine 222 is replaced by cysteine
VQAQQIVPIAEKCFDHAAGTSYLVGETWEKPYQGWMMVDCTCLGEGSGRITCTSRNRCNDQDTRTSYRIGDTWSKKDNRGNLLQCICTGNGRGEWKCERHTSVQTTSSGSGPFTDVRIAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFACDATITDPNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQELSYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAGGGQAQQIVPIAEKCFDHAAGTSYLVGETWEKPYQGWMMVDCTCLGEGSGRITCTSRNRCNDQDTRTSYRIGDTWSKKDNRGNLLQCICTGNGRGEWKCERHTSVQTTSSGSGPFTDVR

SEQ ID NO: 448 - protein, 619 aa, Artificial Sequence
  Polypeptide construct
  MISC_FEATURE (1)..(619): Sequence representing single cysteine substitution mutant made on SEQ ID NO 24, wherein aspartate 237 is replaced by cysteine
VQAQQIVPIAEKCFDHAAGTSYLVGETWEKPYQGWMMVDCTCLGEGSGRITCTSRNRCNDQDTRTSYRIGDTWSKKDNRGNLLQCICTGNGRGEWKCERHTSVQTTSSGSGPFTDVRIAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDPNGKVYFACKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQELSYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAGGGQAQQIVPIAEKCFDHAAGTSYLVGETWEKPYQGWMMVDCTCLGEGSGRITCTSRNRCNDQDTRTSYRIGDTWSKKDNRGNLLQCICTGNGRGEWKCERHTSVQTTSSGSGPFTDVR

SEQ ID NO: 449 - protein, 619 aa, Artificial Sequence
  Polypeptide construct
  MISC_FEATURE (1)..(619): Sequence representing single cysteine substitution mutant made on SEQ ID NO 24, wherein lysine 238 is replaced by cysteine
VQAQQIVPIAEKCFDHAAGTSYLVGETWEKPYQGWMMVDCTCLGEGSGRITCTSRNRCNDQDTRTSYRIGDTWSKKDNRGNLLQCICTGNGRGEWKCERHTSVQTTSSGSGPFTDVRIAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDPNGKVYFADCDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQELSYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAGGGQAQQIVPIAEKCFDHAAGTSYLVGETWEKPYQGWMMVDCTCLGEGSGRITCTSRNRCNDQDTRTSYRIGDTWSKKDNRGNLLQCICTGNGRGEWKCERHTSVQTTSSGSGPFTDVR

SEQ ID NO: 450 - protein, 619 aa, Artificial Sequence
  Polypeptide construct
  MISC_FEATURE (1)..(619): Sequence representing single cysteine substitution mutant made on SEQ ID NO 24, wherein aspartate 239 is replaced by cysteine
VQAQQIVPIAEKCFDHAAGTSYLVGETWEKPYQGWMMVDCTCLGEGSGRITCTSRNRCNDQDTRTSYRIGDTWSKKDNRGNLLQCICTGNGRGEWKCERHTSVQTTSSGSGPFTDVRIAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDPNGKVYFADKCGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQELSYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAGGGQAQQIVPIAEKCFDHAAGTSYLVGETWEKPYQGWMMVDCTCLGEGSGRITCTSRNRCNDQDTRTSYRIGDTWSKKDNRGNLLQCICTGNGRGEWKCERHTSVQTTSSGSGPFTDVR

SEQ ID NO: 451 - protein, 619 aa, Artificial Sequence
  Polypeptide construct
  MISC_FEATURE (1)..(619): Sequence representing single cysteine substitution mutant made on SEQ ID NO 24, wherein glutamate 265 is replaced by cysteine
VQAQQIVPIAEKCFDHAAGTSYLVGETWEKPYQGWMMVDCTCLGEGSGRITCTSRNRCNDQDTRTSYRIGDTWSKKDNRGNLLQCICTGNGRGEWKCERHTSVQTTSSGSGPFTDVRIAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDPNGKVYFADKDGSVTLPTQPVQEFLLSGHVRVRPYKCKPIQNQAKSVDVEYTVQFTPLNPDDDFRPGLKDTKLLKTLAIGDTITSQELLAQAQSILNKNHPGYTIYERDSSIVTHDNDIFRTILPMDQELSYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAGGGQAQQIVPIAEKCFDHAAGTSYLVGETWEKPYQGWMMVDCTCLGEGSGRITCTSRNRCNDQDTRTSYRIGDTWSKKDNRGNLLQCICTGNGRGEWKCERHTSVQTTSSGSGPFTDVR

SEQ ID NO: 452 - protein, 619 aa, Artificial Sequence
  Polypeptide construct
  MISC_FEATURE (1)..(619): Sequence representing single cysteine substitution mutant made on SEQ ID NO 24, wherein lysine 273 is replaced by cysteine
VQAQQIVPIAEKCFDHAAGTSYLVGETWEKPYQGWMMVDCTCLGEGSGRITCTSRNRCNDQDTRTSYRIGDTWSKKDNRGNLLQCICTGNGRGEWKCERHTSVQTTSSGSGPFTDVRIAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDPNGKVYFADKDGSVTLPTQPVQEFLLSGHVRVRPYKEKPIQNQACSVDVEYTVQFTPLNPDDDFRPGLKDTKLLKTLAIGDTITSQELLAQAQSILNKNHPGYTIYERDSSIVTHDNDIFRTILPMDQELSYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAGGGQAQQIVPIAEKCFDHAAGTSYLVGETWEKPYQGWMMVDCTCLGEGSGRITCTSRNRCNDQDTRTSYRIGDTWSKKDNRGNLLQCICTGNGRGEWKCERHTSVQTTSSGSGPFTDVR

SEQ ID NO: 453 - protein, 619 aa, Artificial Sequence
  Polypeptide construct
  MISC_FEATURE (1)..(619): Sequence representing single cysteine substitution mutant made on SEQ ID NO 24, wherein aspartate 290 is replaced by cysteine
VQAQQIVPIAEKCFDHAAGTSYLVGETWEKPYQGWMMVDCTCLGEGSGRITCTSRNRCNDQDTRTSYRIGDTWSKKDNRGNLLQCICTGNGRGEWKCERHTSVQTTSSGSGPFTDVRIAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDPNGKVYFADKDGSVTLPTQPVQEFLLSGHVRVRPYKEKPIQNQAKSVDVEYTVQFTPLNPDCDFRPGLKDTKLLKTLAIGDTITSQELLAQAQSILNKNHPGYTIYERDSSIVTHDNDIFRTILPMDQELSYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAGGGQAQQIVPIAEKCFDHAAGTSYLVGETWEKPYQGWMMVDCTCLGEGSGRITCTSRNRCNDQDTRTSYRIGDTWSKKDNRGNLLQCICTGNGRGEWKCERHTSVQTTSSGSGPFTDVR

SEQ ID NO: 454 - protein, 619 aa, Artificial Sequence
  Polypeptide construct
  MISC_FEATURE (1)..(619): Sequence representing single cysteine substitution mutant made on SEQ ID NO 24, wherein aspartate 291 is replaced by cysteine
VQAQQIVPIAEKCFDHAAGTSYLVGETWEKPYQGWMMVDCTCLGEGSGRITCTSRNRCNDQDTRTSYRIGDTWSKKDNRGNLLQCICTGNGRGEWKCERHTSVQTTSSGSGPFTDVRIAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDPNGKVYFADKDGSVTLPTQPVQEFLLSGHVRVRPYKEKPIQNQAKSVDVEYTVQFTPLNPDDCFRPGLKDTKLLKTLAIGDTITSQELLAQAQSILNKNHPGYTIYERDSSIVTHDNDIFRTILPMDQELSYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAGGGQAQQIVPIAEKCFDHAAGTSYLVGETWEKPYQGWMMVDCTCLGEGSGRITCTSRNRCNDQDTRTSYRIGDTWSKKDNRGNLLQCICTGNGRGEWKCERHTSVQTTSSGSGPFTDVR

SEQ ID NO: 455 - protein, 619 aa, Artificial Sequence
  Polypeptide construct
  MISC_FEATURE (1)..(619): Sequence representing single cysteine substitution mutant made on SEQ ID NO 24, wherein leucine 296 is replaced by cysteine
VQAQQIVPIAEKCFDHAAGTSYLVGETWEKPYQGWMMVDCTCLGEGSGRITCTSRNRCNDQDTRTSYRIGDTWSKKDNRGNLLQCICTGNGRGEWKCERHTSVQTTSSGSGPFTDVRIAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDPNGKVYFADKDGSVTLPTQPVQEFLLSGHVRVRPYKEKPIQNQAKSVDVEYTVQFTPLNPDDDFRPGCKDTKLLKTLAIGDTITSQELLAQAQSILNKNHPGYTIYERDSSIVTHDNDIFRTILPMDQELSYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAGGGQAQQIVPIAEKCFDHAAGTSYLVGETWEKPYQGWMMVDCTCLGEGSGRITCTSRNRCNDQDTRTSYRIGDTWSKKDNRGNLLQCICTGNGRGEWKCERHTSVQTTSSGSGPFTDVR

SEQ ID NO: 456 - protein, 619 aa, Artificial Sequence
  Polypeptide construct
  MISC_FEATURE (1)..(619): Sequence representing single cysteine substitution mutant made on SEQ ID NO 24, wherein aspartate 298 is replaced by cysteine
VQAQQIVPIAEKCFDHAAGTSYLVGETWEKPYQGWMMVDCTCLGEGSGRITCTSRNRCNDQDTRTSYRIGDTWSKKDNRGNLLQCICTGNGRGEWKCERHTSVQTTSSGSGPFTDVRIAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDPNGKVYFADKDGSVTLPTQPVQEFLLSGHVRVRPYKEKPIQNQAKSVDVEYTVQFTPLNPDDDFRPGLKCTKLLKTLAIGDTITSQELLAQAQSILNKNHPGYTIYERDSSIVTHDNDIFRTILPMDQELSYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAGGGQAQQIVPIAEKCFDHAAGTSYLVGETWEKPYQGWMMVDCTCLGEGSGRITCTSRNRCNDQDTRTSYRIGDTWSKKDNRGNLLQCICTGNGRGEWKCERHTSVQTTSSGSGPFTDVR

SEQ ID NO: 457 - protein, 619 aa, Artificial Sequence
  Polypeptide construct
  MISC_FEATURE (1)..(619): Sequence representing single cysteine substitution mutant made on SEQ ID NO 24, wherein serine 322 is replaced by cysteine
VQAQQIVPIAEKCFDHAAGTSYLVGETWEKPYQGWMMVDCTCLGEGSGRITCTSRNRCNDQDTRTSYRIGDTWSKKDNRGNLLQCICTGNGRGEWKCERHTSVQTTSSGSGPFTDVRIAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDPNGKVYFADKDGSVTLPTQPVQEFLLSGHVRVRPYKEKPIQNQAKSVDVEYTVQFTPLNPDDDFRPGLKDTKLLKTLAIGDTITSQELLAQAQCILNKNHPGYTIYERDSSIVTHDNDIFRTILPMDQELSYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAGGGQAQQIVPIAEKCFDHAAGTSYLVGETWEKPYQGWMMVDCTCLGEGSGRITCTSRNRCNDQDTRTSYRIGDTWSKKDNRGNLLQCICTGNGRGEWKCERHTSVQTTSSGSGPFTDVR

SEQ ID NO: 458 - protein, 619 aa, Artificial Sequence
  Polypeptide construct
  MISC_FEATURE (1)..(619): Sequence representing single cysteine substitution mutant made on SEQ ID NO 24, wherein isoleucine 371 is replaced by cysteine
VQAQQIVPIAEKCFDHAAGTSYLVGETWEKPYQGWMMVDCTCLGEGSGRITCTSRNRCNDQDTRTSYRIGDTWSKKDNRGNLLQCICTGNGRGEWKCERHTSVQTTSSGSGPFTDVRIAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDPNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQELSYRVKNREQAYRCNKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAGGGQAQQIVPIAEKCFDHAAGTSYLVGETWEKPYQGWMMVDCTCLGEGSGRITCTSRNRCNDQDTRTSYRIGDTWSKKDNRGNLLQCICTGNGRGEWKCERHTSVQTTSSGSGPFTDVR

SEQ ID NO: 459 - protein, 619 aa, Artificial Sequence
  Polypeptide construct
  MISC_FEATURE (1)..(619): Sequence representing single cysteine substitution mutant made on SEQ ID NO 24, wherein asparagine 372 is replaced by cysteine
VQAQQIVPIAEKCFDHAAGTSYLVGETWEKPYQGWMMVDCTCLGEGSGRITCTSRNRCNDQDTRTSYRIGDTWSKKDNRGNLLQCICTGNGRGEWKCERHTSVQTTSSGSGPFTDVRIAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDPNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQELSYRVKNREQAYRICKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAGGGQAQQIVPIAEKCFDHAAGTSYLVGETWEKPYQGWMMVDCTCLGEGSGRITCTSRNRCNDQDTRTSYRIGDTWSKKDNRGNLLQCICTGNGRGEWKCERHTSVQTTSSGSGPFTDVR

SEQ ID NO: 460 - protein, 619 aa, Artificial Sequence
  Polypeptide construct
  MISC_FEATURE (1)..(619): Sequence representing single cysteine substitution mutant made on SEQ ID NO 24, wherein lysine  373 is replaced by cysteine
VQAQQIVPIAEKCFDHAAGTSYLVGETWEKPYQGWMMVDCTCLGEGSGRITCTSRNRCNDQDTRTSYRIGDTWSKKDNRGNLLQCICTGNGRGEWKCERHTSVQTTSSGSGPFTDVRIAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDPNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQELSYRVKNREQAYRINCKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAGGGQAQQIVPIAEKCFDHAAGTSYLVGETWEKPYQGWMMVDCTCLGEGSGRITCTSRNRCNDQDTRTSYRIGDTWSKKDNRGNLLQCICTGNGRGEWKCERHTSVQTTSSGSGPFTDVR

SEQ ID NO: 461 - protein, 619 aa, Artificial Sequence
  Polypeptide construct
  MISC_FEATURE (1)..(619): Sequence representing single cysteine substitution mutant made on SEQ ID NO 24, wherein lysine 374 is replaced by cysteine
VQAQQIVPIAEKCFDHAAGTSYLVGETWEKPYQGWMMVDCTCLGEGSGRITCTSRNRCNDQDTRTSYRIGDTWSKKDNRGNLLQCICTGNGRGEWKCERHTSVQTTSSGSGPFTDVRIAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDPNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQELSYRVKNREQAYRINKCSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAGGGQAQQIVPIAEKCFDHAAGTSYLVGETWEKPYQGWMMVDCTCLGEGSGRITCTSRNRCNDQDTRTSYRIGDTWSKKDNRGNLLQCICTGNGRGEWKCERHTSVQTTSSGSGPFTDVR

SEQ ID NO: 462 - protein, 619 aa, Artificial Sequence
  Polypeptide construct
  MISC_FEATURE (1)..(619): Sequence representing single cysteine substitution mutant made on SEQ ID NO 24, wherein serine 375 is replaced by cysteine
VQAQQIVPIAEKCFDHAAGTSYLVGETWEKPYQGWMMVDCTCLGEGSGRITCTSRNRCNDQDTRTSYRIGDTWSKKDNRGNLLQCICTGNGRGEWKCERHTSVQTTSSGSGPFTDVRIAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDPNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQELSYRVKNREQAYRINKKCGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAGGGQAQQIVPIAEKCFDHAAGTSYLVGETWEKPYQGWMMVDCTCLGEGSGRITCTSRNRCNDQDTRTSYRIGDTWSKKDNRGNLLQCICTGNGRGEWKCERHTSVQTTSSGSGPFTDVR

SEQ ID NO: 463 - protein, 619 aa, Artificial Sequence
  Polypeptide construct
  MISC_FEATURE (1)..(619): Sequence representing single cysteine substitution mutant made on SEQ ID NO 24, wherein leucine 377 is replaced by cysteine
VQAQQIVPIAEKCFDHAAGTSYLVGETWEKPYQGWMMVDCTCLGEGSGRITCTSRNRCNDQDTRTSYRIGDTWSKKDNRGNLLQCICTGNGRGEWKCERHTSVQTTSSGSGPFTDVRIAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDPNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQELSYRVKNREQAYRINKKSGCNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAGGGQAQQIVPIAEKCFDHAAGTSYLVGETWEKPYQGWMMVDCTCLGEGSGRITCTSRNRCNDQDTRTSYRIGDTWSKKDNRGNLLQCICTGNGRGEWKCERHTSVQTTSSGSGPFTDVR

SEQ ID NO: 464 - protein, 619 aa, Artificial Sequence
  Polypeptide construct
  MISC_FEATURE (1)..(619): Sequence representing single cysteine substitution mutant made on SEQ ID NO 24, wherein glutamate 398 is replaced by cysteine
VQAQQIVPIAEKCFDHAAGTSYLVGETWEKPYQGWMMVDCTCLGEGSGRITCTSRNRCNDQDTRTSYRIGDTWSKKDNRGNLLQCICTGNGRGEWKCERHTSVQTTSSGSGPFTDVRIAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDPNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQELSYRVKNREQAYRINKKSGLNEEINNTDLISEKYYVLKKGCKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAGGGQAQQIVPIAEKCFDHAAGTSYLVGETWEKPYQGWMMVDCTCLGEGSGRITCTSRNRCNDQDTRTSYRIGDTWSKKDNRGNLLQCICTGNGRGEWKCERHTSVQTTSSGSGPFTDVR

SEQ ID NO: 465 - protein, 619 aa, Artificial Sequence
  Polypeptide construct
  MISC_FEATURE (1)..(619): Sequence representing single cysteine substitution mutant made on SEQ ID NO 24, wherein lysine 399 is replaced by cysteine
VQAQQIVPIAEKCFDHAAGTSYLVGETWEKPYQGWMMVDCTCLGEGSGRITCTSRNRCNDQDTRTSYRIGDTWSKKDNRGNLLQCICTGNGRGEWKCERHTSVQTTSSGSGPFTDVRIAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDPNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQELSYRVKNREQAYRINKKSGLNEEINNTDLISEKYYVLKKGECPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAGGGQAQQIVPIAEKCFDHAAGTSYLVGETWEKPYQGWMMVDCTCLGEGSGRITCTSRNRCNDQDTRTSYRIGDTWSKKDNRGNLLQCICTGNGRGEWKCERHTSVQTTSSGSGPFTDVR

SEQ ID NO: 466 - protein, 619 aa, Artificial Sequence
  Polypeptide construct
  MISC_FEATURE (1)..(619): Sequence representing single cysteine substitution mutant made on SEQ ID NO 24, wherein phenyalanine 404 is replaced by cysteine
VQAQQIVPIAEKCFDHAAGTSYLVGETWEKPYQGWMMVDCTCLGEGSGRITCTSRNRCNDQDTRTSYRIGDTWSKKDNRGNLLQCICTGNGRGEWKCERHTSVQTTSSGSGPFTDVRIAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDPNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQELSYRVKNREQAYRINKKSGLNEEINNTDLISEKYYVLKKGEKPYDPCDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAGGGQAQQIVPIAEKCFDHAAGTSYLVGETWEKPYQGWMMVDCTCLGEGSGRITCTSRNRCNDQDTRTSYRIGDTWSKKDNRGNLLQCICTGNGRGEWKCERHTSVQTTSSGSGPFTDVR

SEQ ID NO: 467 - protein, 619 aa, Artificial Sequence
  Polypeptide construct
  MISC_FEATURE (1)..(619): Sequence representing single cysteine substitution mutant made on SEQ ID NO 24, wherein aspartate 420 is replaced by cysteine
VQAQQIVPIAEKCFDHAAGTSYLVGETWEKPYQGWMMVDCTCLGEGSGRITCTSRNRCNDQDTRTSYRIGDTWSKKDNRGNLLQCICTGNGRGEWKCERHTSVQTTSSGSGPFTDVRIAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDPNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQELSYRVKNREQAYRINKKSGLNEEINNTDLISEKYYVLKKGEKPYDPFDRSHLKLFTIKYVDVCTNELLKSEQLLTASERNLDFRDLYDPRDKAKLLYNNLDAFGIMDYTLTGKVEDNHDDTNRIITVYMGKRPEGENASYHLAGGGQAQQIVPIAEKCFDHAAGTSYLVGETWEKPYQGWMMVDCTCLGEGSGRITCTSRNRCNDQDTRTSYRIGDTWSKKDNRGNLLQCICTGNGRGEWKCERHTSVQTTSSGSGPFTDVR

SEQ ID NO: 468 - protein, 619 aa, Artificial Sequence
  Polypeptide construct
  MISC_FEATURE (1)..(619): Sequence representing single cysteine substitution mutant made on SEQ ID NO 24, wherein leucine 438 is replaced by cysteine
VQAQQIVPIAEKCFDHAAGTSYLVGETWEKPYQGWMMVDCTCLGEGSGRITCTSRNRCNDQDTRTSYRIGDTWSKKDNRGNLLQCICTGNGRGEWKCERHTSVQTTSSGSGPFTDVRIAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDPNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQELSYRVKNREQAYRINKKSGLNEEINNTDLISEKYYVLKKGEKPYDPFDRSHLKLFTIKYVDVDTNELLKSEQLLTASERNCDFRDLYDPRDKAKLLYNNLDAFGIMDYTLTGKVEDNHDDTNRIITVYMGKRPEGENASYHLAGGGQAQQIVPIAEKCFDHAAGTSYLVGETWEKPYQGWMMVDCTCLGEGSGRITCTSRNRCNDQDTRTSYRIGDTWSKKDNRGNLLQCICTGNGRGEWKCERHTSVQTTSSGSGPFTDVR

SEQ ID NO: 469 - protein, 619 aa, Artificial Sequence
  Polypeptide construct
  MISC_FEATURE (1)..(619): Sequence representing single cysteine substitution mutant made on SEQ ID NO 24, wherein leucine 443 is replaced by cysteine
VQAQQIVPIAEKCFDHAAGTSYLVGETWEKPYQGWMMVDCTCLGEGSGRITCTSRNRCNDQDTRTSYRIGDTWSKKDNRGNLLQCICTGNGRGEWKCERHTSVQTTSSGSGPFTDVRIAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDPNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQELSYRVKNREQAYRINKKSGLNEEINNTDLISEKYYVLKKGEKPYDPFDRSHLKLFTIKYVDVDTNELLKSEQLLTASERNLDFRDCYDPRDKAKLLYNNLDAFGIMDYTLTGKVEDNHDDTNRIITVYMGKRPEGENASYHLAGGGQAQQIVPIAEKCFDHAAGTSYLVGETWEKPYQGWMMVDCTCLGEGSGRITCTSRNRCNDQDTRTSYRIGDTWSKKDNRGNLLQCICTGNGRGEWKCERHTSVQTTSSGSGPFTDVR

SEQ ID NO: 470 - protein, 619 aa, Artificial Sequence
  Polypeptide construct
  MISC_FEATURE (1)..(619): Sequence representing single cysteine substitution mutant made on SEQ ID NO 24, wherein alanine 450 is replaced by cysteine
VQAQQIVPIAEKCFDHAAGTSYLVGETWEKPYQGWMMVDCTCLGEGSGRITCTSRNRCNDQDTRTSYRIGDTWSKKDNRGNLLQCICTGNGRGEWKCERHTSVQTTSSGSGPFTDVRIAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDPNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQELSYRVKNREQAYRINKKSGLNEEINNTDLISEKYYVLKKGEKPYDPFDRSHLKLFTIKYVDVDTNELLKSEQLLTASERNLDFRDLYDPRDKCKLLYNNLDAFGIMDYTLTGKVEDNHDDTNRIITVYMGKRPEGENASYHLAGGGQAQQIVPIAEKCFDHAAGTSYLVGETWEKPYQGWMMVDCTCLGEGSGRITCTSRNRCNDQDTRTSYRIGDTWSKKDNRGNLLQCICTGNGRGEWKCERHTSVQTTSSGSGPFTDVR

SEQ ID NO: 471 - protein, 619 aa, Artificial Sequence
  Polypeptide construct
  MISC_FEATURE (1)..(619): Sequence representing single cysteine substitution mutant made on SEQ ID NO 24, wherein aspartate 464 is replaced by cysteine
VQAQQIVPIAEKCFDHAAGTSYLVGETWEKPYQGWMMVDCTCLGEGSGRITCTSRNRCNDQDTRTSYRIGDTWSKKDNRGNLLQCICTGNGRGEWKCERHTSVQTTSSGSGPFTDVRIAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDPNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQELSYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMCYTLTGKVEDNHDDTNRIITVYMGKRPEGENASYHLAGGGQAQQIVPIAEKCFDHAAGTSYLVGETWEKPYQGWMMVDCTCLGEGSGRITCTSRNRCNDQDTRTSYRIGDTWSKKDNRGNLLQCICTGNGRGEWKCERHTSVQTTSSGSGPFTDVR

SEQ ID NO: 472 - protein, 619 aa, Artificial Sequence
  Polypeptide construct
  MISC_FEATURE (1)..(619): Sequence representing single cysteine substitution mutant made on SEQ ID NO 24, wherein aspartate 477 is replaced by cysteine
VQAQQIVPIAEKCFDHAAGTSYLVGETWEKPYQGWMMVDCTCLGEGSGRITCTSRNRCNDQDTRTSYRIGDTWSKKDNRGNLLQCICTGNGRGEWKCERHTSVQTTSSGSGPFTDVRIAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDPNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQELSYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDCTNRIITVYMGKRPEGENASYHLAGGGQAQQIVPIAEKCFDHAAGTSYLVGETWEKPYQGWMMVDCTCLGEGSGRITCTSRNRCNDQDTRTSYRIGDTWSKKDNRGNLLQCICTGNGRGEWKCERHTSVQTTSSGSGPFTDVR

SEQ ID NO: 473 - protein, 619 aa, Artificial Sequence
  Polypeptide construct
  MISC_FEATURE (1)..(619): Sequence representing single cysteine substitution mutant made on SEQ ID NO 24, wherein arginine 489 is replaced by cysteine
VQAQQIVPIAEKCFDHAAGTSYLVGETWEKPYQGWMMVDCTCLGEGSGRITCTSRNRCNDQDTRTSYRIGDTWSKKDNRGNLLQCICTGNGRGEWKCERHTSVQTTSSGSGPFTDVRIAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDPNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQELSYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKCPEGENASYHLAGGGQAQQIVPIAEKCFDHAAGTSYLVGETWEKPYQGWMMVDCTCLGEGSGRITCTSRNRCNDQDTRTSYRIGDTWSKKDNRGNLLQCICTGNGRGEWKCERHTSVQTTSSGSGPFTDVR

SEQ ID NO: 474 - protein, 619 aa, Artificial Sequence
  Polypeptide construct
  MISC_FEATURE (1)..(619): Sequence representing single cysteine substitution mutant made on SEQ ID NO 24, wherein histidine 518 is replaced by cysteine
VQAQQIVPIAEKCFDHAAGTSYLVGETWEKPYQGWMMVDCTCLGEGSGRITCTSRNRCNDQDTRTSYRIGDTWSKKDNRGNLLQCICTGNGRGEWKCERHTSVQTTSSGSGPFTDVRIAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDPNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQELSYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAGGGQAQQIVPIAEKCFDCAAGTSYLVGETWEKPYQGWMMVDCTCLGEGSGRITCTSRNRCNDQDTRTSYRIGDTWSKKDNRGNLLQCICTGNGRGEWKCERHTSVQTTSSGSGPFTDVR

SEQ ID NO: 475 - protein, 619 aa, Artificial Sequence
  Polypeptide construct
  MISC_FEATURE (1)..(619): Sequence representing single cysteine substitution mutant made on SEQ ID NO 24, wherein alanine 519 is replaced by cysteine
VQAQQIVPIAEKCFDHAAGTSYLVGETWEKPYQGWMMVDCTCLGEGSGRITCTSRNRCNDQDTRTSYRIGDTWSKKDNRGNLLQCICTGNGRGEWKCERHTSVQTTSSGSGPFTDVRIAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDPNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQELSYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAGGGQAQQIVPIAEKCFDHCAGTSYLVGETWEKPYQGWMMVDCTCLGEGSGRITCTSRNRCNDQDTRTSYRIGDTWSKKDNRGNLLQCICTGNGRGEWKCERHTSVQTTSSGSGPFTDVR

SEQ ID NO: 476 - protein, 619 aa, Artificial Sequence
  Polypeptide construct
  MISC_FEATURE (1)..(619): Sequence representing single cysteine substitution mutant made on SEQ ID NO 24, wherein aspartate 564 is replaced by cysteine
VQAQQIVPIAEKCFDHAAGTSYLVGETWEKPYQGWMMVDCTCLGEGSGRITCTSRNRCNDQDTRTSYRIGDTWSKKDNRGNLLQCICTGNGRGEWKCERHTSVQTTSSGSGPFTDVRIAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDPNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQELSYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAGGGQAQQIVPIAEKCFDHAAGTSYLVGETWEKPYQGWMMVDCTCLGEGSGRITCTSRNRCNDQCTRTSYRIGDTWSKKDNRGNLLQCICTGNGRGEWKCERHTSVQTTSSGSGPFTDVR

SEQ ID NO: 477 - protein, 619 aa, Artificial Sequence
  Polypeptide construct
  MISC_FEATURE (1)..(619): Sequence representing single cysteine substitution mutant made on SEQ ID NO 24, wherein glycine 582 is replaced by cysteine
VQAQQIVPIAEKCFDHAAGTSYLVGETWEKPYQGWMMVDCTCLGEGSGRITCTSRNRCNDQDTRTSYRIGDTWSKKDNRGNLLQCICTGNGRGEWKCERHTSVQTTSSGSGPFTDVRIAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDPNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQELSYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAGGGQAQQIVPIAEKCFDHAAGTSYLVGETWEKPYQGWMMVDCTCLGEGSGRITCTSRNRCNDQDTRTSYRIGDTWSKKDNRCNLLQCICTGNGRGEWKCERHTSVQTTSSGSGPFTDVR

SEQ ID NO: 478 - protein, 619 aa, Artificial Sequence
  Polypeptide construct
  MISC_FEATURE (1)..(619): Sequence representing double cysteine substitution mutant made on SEQ ID NO 24, wherein histidine 16 and leucine 377 are replaced by cysteine
VQAQQIVPIAEKCFDCAAGTSYLVGETWEKPYQGWMMVDCTCLGEGSGRITCTSRNRCNDQDTRTSYRIGDTWSKKDNRGNLLQCICTGNGRGEWKCERHTSVQTTSSGSGPFTDVRIAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDPNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQELSYRVKNREQAYRINKKSGCNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAGGGQAQQIVPIAEKCFDHAAGTSYLVGETWEKPYQGWMMVDCTCLGEGSGRITCTSRNRCNDQDTRTSYRIGDTWSKKDNRGNLLQCICTGNGRGEWKCERHTSVQTTSSGSGPFTDVR

SEQ ID NO: 479 - protein, 619 aa, Artificial Sequence
  Polypeptide construct
  MISC_FEATURE (1)..(619): Sequence representing double cysteine substitution mutant made on SEQ ID NO 24, wherein histidine 16 and serine 322 are replaced by cysteine
VQAQQIVPIAEKCFDCAAGTSYLVGETWEKPYQGWMMVDCTCLGEGSGRITCTSRNRCNDQDTRTSYRIGDTWSKKDNRGNLLQCICTGNGRGEWKCERHTSVQTTSSGSGPFTDVRIAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDPNGKVYFADKDGSVTLPTQPVQEFLLSGHVRVRPYKEKPIQNQAKSVDVEYTVQFTPLNPDDDFRPGLKDTKLLKTLAIGDTITSQELLAQAQCILNKNHPGYTIYERDSSIVTHDNDIFRTILPMDQELSYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAGGGQAQQIVPIAEKCFDHAAGTSYLVGETWEKPYQGWMMVDCTCLGEGSGRITCTSRNRCNDQDTRTSYRIGDTWSKKDNRGNLLQCICTGNGRGEWKCERHTSVQTTSSGSGPFTDVR

SEQ ID NO: 480 - protein, 619 aa, Artificial Sequence
  Polypeptide construct
  MISC_FEATURE (1)..(619): Sequence representing double cysteine substitution mutant made on SEQ ID NO 24, wherein histidine 16 and histidine 518 are replaced by cysteine
VQAQQIVPIAEKCFDCAAGTSYLVGETWEKPYQGWMMVDCTCLGEGSGRITCTSRNRCNDQDTRTSYRIGDTWSKKDNRGNLLQCICTGNGRGEWKCERHTSVQTTSSGSGPFTDVRIAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDPNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQELSYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAGGGQAQQIVPIAEKCFDCAAGTSYLVGETWEKPYQGWMMVDCTCLGEGSGRITCTSRNRCNDQDTRTSYRIGDTWSKKDNRGNLLQCICTGNGRGEWKCERHTSVQTTSSGSGPFTDVR

SEQ ID NO: 481 - protein, 619 aa, Artificial Sequence
  Polypeptide construct
  MISC_FEATURE (1)..(619): Sequence representing double cysteine substitution mutant made on SEQ ID NO 24, wherein alanine 17 and alanine 519 are replaced by cysteine
VQAQQIVPIAEKCFDHCAGTSYLVGETWEKPYQGWMMVDCTCLGEGSGRITCTSRNRCNDQDTRTSYRIGDTWSKKDNRGNLLQCICTGNGRGEWKCERHTSVQTTSSGSGPFTDVRIAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDPNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQELSYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAGGGQAQQIVPIAEKCFDHCAGTSYLVGETWEKPYQGWMMVDCTCLGEGSGRITCTSRNRCNDQDTRTSYRIGDTWSKKDNRGNLLQCICTGNGRGEWKCERHTSVQTTSSGSGPFTDVR

SEQ ID NO: 482 - protein, 619 aa, Artificial Sequence
  Polypeptide construct
  MISC_FEATURE (1)..(619): Sequence representing double cysteine substitution mutant made on SEQ ID NO 24, wherein aspartate 62 and aspartate 564 are replaced by cysteine
VQAQQIVPIAEKCFDHAAGTSYLVGETWEKPYQGWMMVDCTCLGEGSGRITCTSRNRCNDQCTRTSYRIGDTWSKKDNRGNLLQCICTGNGRGEWKCERHTSVQTTSSGSGPFTDVRIAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDPNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQELSYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAGGGQAQQIVPIAEKCFDHAAGTSYLVGETWEKPYQGWMMVDCTCLGEGSGRITCTSRNRCNDQCTRTSYRIGDTWSKKDNRGNLLQCICTGNGRGEWKCERHTSVQTTSSGSGPFTDVR

SEQ ID NO: 483 - protein, 619 aa, Artificial Sequence
  Polypeptide construct
  MISC_FEATURE (1)..(619): Sequence representing double cysteine substitution mutant made on SEQ ID NO 24, wherein glycine 80 and glycine 582 are replaced by cysteine
VQAQQIVPIAEKCFDHAAGTSYLVGETWEKPYQGWMMVDCTCLGEGSGRITCTSRNRCNDQDTRTSYRIGDTWSKKDNRCNLLQCICTGNGRGEWKCERHTSVQTTSSGSGPFTDVRIAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDPNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQELSYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAGGGQAQQIVPIAEKCFDHAAGTSYLVGETWEKPYQGWMMVDCTCLGEGSGRITCTSRNRCNDQDTRTSYRIGDTWSKKDNRCNLLQCICTGNGRGEWKCERHTSVQTTSSGSGPFTDVR

SEQ ID NO: 484 - protein, 619 aa, Artificial Sequence
  Polypeptide construct
  MISC_FEATURE (1)..(619): Sequence representing double cysteine substitution mutant made on SEQ ID NO 24, wherein Histidine 16, leucine 377 and arginine 489 are replaced by cysteine
VQAQQIVPIAEKCFDCAAGTSYLVGETWEKPYQGWMMVDCTCLGEGSGRITCTSRNRCNDQDTRTSYRIGDTWSKKDNRGNLLQCICTGNGRGEWKCERHTSVQTTSSGSGPFTDVRIAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDPNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQELSYRVKNREQAYRINKKSGCNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKCPEGENASYHLAGGGQAQQIVPIAEKCFDHAAGTSYLVGETWEKPYQGWMMVDCTCLGEGSGRITCTSRNRCNDQDTRTSYRIGDTWSKKDNRGNLLQCICTGNGRGEWKCERHTSVQTTSSGSGPFTDVR

SEQ ID NO: 485 - protein, 619 aa, Artificial Sequence
  Polypeptide construct
  MISC_FEATURE (1)..(619): Sequence representing double cysteine substitution mutant made on SEQ ID NO 24, wherein Histidine 16, leucine 377 and histidine 518 are replaced by cysteine
VQAQQIVPIAEKCFDCAAGTSYLVGETWEKPYQGWMMVDCTCLGEGSGRITCTSRNRCNDQDTRTSYRIGDTWSKKDNRGNLLQCICTGNGRGEWKCERHTSVQTTSSGSGPFTDVRIAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDPNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQELSYRVKNREQAYRINKKSGCNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAGGGQAQQIVPIAEKCFDCAAGTSYLVGETWEKPYQGWMMVDCTCLGEGSGRITCTSRNRCNDQDTRTSYRIGDTWSKKDNRGNLLQCICTGNGRGEWKCERHTSVQTTSSGSGPFTDVR

SEQ ID NO: 486 - protein, 415 aa, Artificial Sequence
  Polypeptide construct
  MISC_FEATURE (1)..(415): Sequence having cysteine between isoleucine 88 and alanine 89 in SK
IAGPEWLLDRPSVNNSQLVVSVAGTVEGTNQDISLKFFEIDLTSRPAHGGKTEQGLSPKSKPFATDSGAMSHKLEKADLLKAIQEQLICANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAYDKDRYTEEEREVYSYLRYTGTPIPDNPNDK

SEQ ID NO: 487 - protein, 415 aa, Artificial Sequence
  Polypeptide construct
  MISC_FEATURE (1)..(415): Sequence having cysteine between lysine 256 and lysine 257 in SK
IAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKCKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAYDKDRYTEEEREVYSYLRYTGTPIPDNPNDK

SEQ ID NO: 488 - protein, 415 aa, Artificial Sequence
  Polypeptide construct
  MISC_FEATURE (1)..(415): Sequence having cysteine between aspartate 347 and tyrosine 348 in SK
IAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDCYTLTGKVEDNHDDTNRIITVYMGKRPEGENASYHLAYDKDRYTEEEREVYSYLRYTGTPIPDNPNDK

SEQ ID NO: 489 - protein, 415 aa, Artificial Sequence
  Polypeptide construct
  MISC_FEATURE (1)..(415): Cysteine at N-1 position of SK. Sequence having cysteine at N-terminal in SK
CIAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAYDKDRYTEEEREVYSYLRYTGTPIPDNPNDK

SEQ ID NO: 490 - protein, 415 aa, Artificial Sequence
  Polypeptide construct
  MISC_FEATURE (1)..(415): Cysteine at C+1 position in SK. Sequence having cysteine at C-terminal in SK
IAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAYDKDRYTEEEREVYSYLRYTGTPIPDNPNDKC

SEQ ID NO: 491 - protein, 416 aa, Artificial Sequence
  Polypeptide construct
  MISC_FEATURE (1)..(416): Sequence having cysteine at N-1 and C+1 terminal of SK
CIAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAYDKDRYTEEEREVYSYLRYTGTPIPDNPNDKC

SEQ ID NO: 492 - protein, 387 aa, Artificial Sequence
  Polypeptide construct
  MISC_FEATURE (1)..(387): Sequence having cysteine at C+1 terminal in C-terminal truncated SK (1-383,G3)
IAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAGGGC

SEQ ID NO: 493 - protein, 388 aa, Artificial Sequence
  Polypeptide construct
  MISC_FEATURE (1)..(388): Sequence having cysteine at N-1 and C+1 terminal of C terminal truncated SK (1-383, G3)
CIAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAGGGC

SEQ ID NO: 494 - protein, 421 aa, Artificial Sequence
  Polypeptide construct
  MISC_FEATURE (1)..(421): Sequence having cysteine at N terminal in N-terminally his tagged SK
CHHHHHHIAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAYDKDRYTEEEREVYSYLRYTGTPIPDNPNDK

SEQ ID NO: 495 - protein, 421 aa, Artificial Sequence
  Polypeptide construct
  MISC_FEATURE (1)..(421): Sequence having cysteine at C-terminal in C-terminally his tag SK
IAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAYDKDRYTEEEREVYSYLRYTGTPIPDNPNDKHHHHHHC

SEQ ID NO: 496 - protein, 435 aa, Artificial Sequence
  Polypeptide construct
  MISC_FEATURE (1)..(435): Sequence having cysteine with additional 20 amino acid tag of pET 15b before nSK
CHHHHHHSSGLVPRGSHMLEDIAGPEWLLDRPSVNNSQLVVSVAGTVEGTNQDISLKFFEIDLTSRPAHGGKTEQGLSPKSKPFATDSGAMSHKLEKADLLKAIQEQLIANVHSNDDYFEVIDFASDATITDRNGKVYFADKDGSVTLPTQPVQEFLLSGHVRVRPYKEKPIQNQAKSVDVEYTVQFTPLNPDDDFRPGLKDTKLLKTLAIGDTITSQELLAQAQSILNKNHPGYTIYERDSSIVTHDNDIFRTILPMDQEFTYRVKNREQAYRINKKSGLNEEINNTDLISEKYYVLKKGEKPYDPFDRSHLKLFTIKYVDVDTNELLKSEQLLTASERNLDFRDLYDPRDKAKLLYNNLDAFGIMDYTLTGKVEDNHDDTNRIITVYMGKRPEGENASYHLAYDKDRYTEEEREVYSYLRYTGTPIPDNPNDK

---

What is claimed is:

1. A purified mutant streptokinase polypeptide comprising substitution of one to six amino acid residues of SEQ ID NO:4 with a cysteine residue, wherein any residue substituted is selected from the group consisting of S1, G34, S42, A49, I73, S78, D80, D81, D87, S90, D105, K106, D107, E133, K141, D158, D159, L164, D166, S190, A236, I239, N240, K241, K242, S243, L245, E266, K267, F272, D288, L306, L311, A318, D332, D345, R357, and A368.

2. The mutant kinase of claim 1, wherein the cysteine substitutions are selected from the group consisting of G34; I73, S190; S78, N240; D87, R357; S90, F272; K106, D345; 173, 5190, R357; S78, N240, D332; S78, N240, F272; D87, L245, R357; and S90, L245, F272.

3. A mutant streptokinase polypeptide according to claim 1, wherein the polypeptide is SEQ ID NO: 163.

4. A mutant streptokinase polypeptide according to claim 1, wherein the polypeptide further comprises an extension at the N-terminus, C-terminus, or N- and C-termini of the polypeptide, wherein any extension comprises a fibrin binding domain.

5. A mutant streptokinase polypeptide according to claim 4, comprising an amino sequence selected from the group consisting of SEQ ID NO: 22, of SEQ ID NO: 23, and of SEQ ID NO: 24.

6. A mutant streptokinase according to claim 1, wherein any substituted cysteine moiety is modified with a cysteine-reactive moiety comprising polyethylene glycol.

7. A mutant streptokinase according to claim 6, wherein the polyethylene glycol is a linear or branch polymer of molecular size ranging from about 5,000 to about 40,000 daltons.

8. A composition comprising the mutant streptokinase according to claim 7.

9. A composition comprising the mutant streptokinase according to claim 1 or 4.

10. A purified mutant streptokinase polypeptide comprising substitution of one to six amino acid residues of SEQ ID NO:22 with a cysteine residue wherein any residue substituted is selected from the group consisting of S133, G167, S174, A181, I205, S210, D212, D213, D219, S222, D237, K238, D239, E265, K273, D290, D291, L296, D298, 5322, A368, I371, N372, K373, K374, 5375, L377, E398, K399, F404, D420, L438, L443, A450, D464, D477, R489, and A500.

11. A purified mutant streptokinase polypeptide comprising substitution of one to six amino acid residues of sequence selected from SEQ ID NO:23 with a cysteine residue wherein any residue substituted is selected from the group consisting of S16, G49, S57, A64,188, S93, D95, D96, D102, S105, D120, K121, D122, E148, K156, D173, D174, L179, D181, S205, A251, 1254, N255, K256, K257, S258, L260, E281, K282, F287, D303, L321, L326, A333, D347, D360, and R372.

12. A purified mutant streptokinase polypeptide comprising substitution of one to six amino acid residues of sequence selected from SEQ ID NO:24 with a cysteine residue wherein any residue substituted is selected from the group consisting of S133, G167, S174, A181, I205, S210, D212, D213, D219, S222, D237, K238, D239, E265, K273, D290, D291, L296, D298, S322, A368, I371, N372, K373, K374, 5375, L377, E398, K399, F404, D420, L438, L443, A450, D464, D477, R489, and A500.

* * * * *